United States Patent 7,368,527 (HADDE71 POLYPEPTIDES) - sequence listing, part 2

SEQ ID NO: 1549 - DNA, 1279 bp, Homo sapiens
  misc_feature (1188)..(1188): n equals a,t,g, or c
  misc_feature (1224)..(1224): n equals a,t,g, or c
  misc_feature (1278)..(1278): n equals a,t,g, or c
gaattcggcacgagtcatgaagggcttcttcctcattgtcttcatgttgagtagggctgaggaggaggaagatgaggggttagtcttgctgtcttgcgggtgacagatgtggaagtaaatcctcatgtaggtgggaatgagcagttcaaacctatgttgttcaagggccaactatagttgattaactcatatctctacagttaattttcaaacagatgtgatagctgaatgagaacttttaagatagtactggacagtaaccttattggaactggaatggcctttagactttttgtgtccagtttcttctcacctcctctttctcttcaaatgtgcaactgaaactgagagacctcagtcccatgtccaaggtcaggcagatacttagcggcagagtgaggactccagcccatttctgcagctctgctgtgcagtggaagatttgggacaagtacattatttaaaaatgcccacccactaaatattacattcctaacttttcccaatacacaaatatgcttgaacttttaaaagcttgtttttggtcgtgcttggtttggaatgtgaatgactaaaactacctttagcaatttcccaaagtgtaagttcaaatgtacagagaatttttttcctgaatgcccaacacaatatgcagttttacaacacataccagattcttagattcatttggtgaaggaagcctctgaattaaaacttttaaatatttctgatttgcaaccagacgaaaaagaagaaaattgacaacttttttgatgcaactttgtgaaatcatggtgttcctggtttttctggtctggtttttgttgttgttttgttttgttttgccacagtttagttcctcacctgatctttccttgtatccacttcagartctctgaaatgttatctgtttgttggttcctgggaaattgagagcctttycaaagactccatctagaagcatatttaaaagtgtgaaagaagacatttatgcgaccaacaaacatatgaaaaaaagcttatcatcatgggtcattagagaaatgcacagcagaaccacaatkagataccatctcatrccagttagaatggtgatcactaaaaagtcaggaaaggccaggggcggtgactcatgcctgtaatcccagcactttgggaggctgaggcgggtgggatcacctggaggtncaggagtacaagaccagcctggccaacatagtgaancccatctctacttaaaaatacaaaaattagctgggtgtggtggcgggcactgtna

SEQ ID NO: 1550 - DNA, 724 bp, Homo sapiens
aaaacacagaactcggatgaaacgtcacacggtctgggctaaagatcttgctctttaatttcccagcaggtaaccttgtggcagtcactaaccctctctacacctcaatgttctcatctgtaaaatggaaatgatgacccctgggtctcccaggaccgtgaggggtcctgaaagggcaggtgtgcgcggtgctttgtagatgataaggcatctcagaaacaccggggctttactgttattttctctccagcttgtttgggcagacaaaagagaaatcgagcccagtcattcttagcacagccaagaagggcagatttcaaaaggagccttgcttcaaactgaggaaaaccaaaaaggaaaaaacaacaaacacagctgcccctaccctccagtccacaaaacagtctgtgtctgacaagctgggctctgccagcggctcacccccagactcctgcaccagctggccttcctgacctgtgtgccctgggagccaggccgactcttcacacttccagtcaccgacacagtgcaatgcaacccattcttgctcaaggcctccttagaaattattcctcccattgctcgaacctgggagttggagattgcagtgagccacgatggtgccactccactctagcctgggtgacacagtgagaccctgcctcaaaaaaaagaaaagaaaagggaggggagggaagggaaaattaaaaaaaaaaaaaaaaaa

SEQ ID NO: 1551 - DNA, 859 bp, Homo sapiens
ctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatctccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaaaaaaaaaa

SEQ ID NO: 1552 - DNA, 1932 bp, Homo sapiens
gttattttgttaatagtttcttttgctatgcagaagctcttaataagtttaatgagatcctgatatgtttaggctttgtatccccacccaaatctcatcttgaattataatctccataatcaccacatggagagaccaggtggaggtaattgaatctgggggtggtttcacccatgctgttcttgtgatagtgaatgagttctcacgagatctaatggttttatgaggggctcttcccagctttgcctggtacttctccttcctgccgccttgtgaaaaaggtgcattgcatccctttcaccttctcctataattgtaagtttcctgaggccttcccagccatgctgaacttcaagtcaattaaacctttttctttataaattactcagtctctggtggttctttatagcagtgtgaaaatggactaatgaagttcccatttatgaatttttgcttttgttgcaattgcttttgacatcttagtcatgaaatcctkgcckgttctaagtccaggatggtawtgccwaggttgtcttccagggtttttctaattttgtgttttgcatttaagtgtttaatccatcttgagttgatttttgtatattgtgtatggaaggggtccagtttcaatcttttgcatatggctagttagttatcccagtaccatttattgaaaagacagtcttttccccattgctcgtttttgtcagttttattgatgatcagataatcatagctgtgtggctttatttctgggttctctattctgttctattggtttatgtccctgtttttgtgccagcaccatgctgttttggttaacatagccctgtagtatagtttgaggtcagatagcctgatgcttccagctttgttctttttcttaagattgccttggctatttggcctcttttttggttccacatgaactttaaaacagttgtttctagttttgtgaagaatgtcattggtagtttgatagaaatagcatttaatctgtaaattgctttgtgcagtatggccttttaatgatattgcttcttcctatccatgagcatgatatgttttccattttgtttgtatcctctctgatttctttgtgcagtgttttgtaattctcattgtagagatttttcacctccctggttagttgtattttaccctagatattttattctttttgtgaaaattgtgaatgggattgccttcctgatttgactgccagcttggttactgttggtttatagaaatgctagtgatttttgtacattgattttctttctaaaactttgctgaagttttttttattagcagaaggagctttgcggctgagactatggggttttctagatatagaatcatgtcagcttcaaatagggataattttacttcctctcttcctatttggatgccctttatttctttctcttgcctgattactctggctgggatttcctatgttgaataggagtcatgagggagggcatcaaatctacacatatcaaatactaaccttgaatgtaagtgggctaaatgccccacttaaaaggtaaaggggggcaagctgaataaaaaagcaagactcaatggtatgctgtctttgagacctatctcacatgtgatgacacccatcggctcaaaataaaggaatggaggaaaatctaccaagcatgtagaaaacagaaaaaagcaggggttgcatcctaatttcagaccaaacagacgtcaaacaaacaaagttcaaaaaagacaaagaaggggccgggagtggtggctcacacctgtaatcccagcactttgggaggccaaggtgggcggattacaaggtcaggagatcgagaccatcctggccaacattgtgaaaccccatctctactaaaatccaaaaaaaaaaaaaaaaaactcgagggggggcccgtacccaatcgtcct

SEQ ID NO: 1553 - DNA, 1302 bp, Homo sapiens
  misc_feature (158)..(158): n equals a,t,g, or c
  misc_feature (749)..(749): n equals a,t,g, or c
agctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtncctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcangaagggcaacacgcacgtytggggtgcacagccctgatgggagcagcttggctgtgagcaccaggccaagactcctgagaacaggcagcccagtcctgcgactyccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatarctcaytccctararcctgackccggggcccctgacccctgarcctyarawtccaatacctyactycccagagcctgatgccggggcccctgacccctgatctacggaggcctgctcccggaccgtgcgggcaccagtgcagagctgccttggttcctggacccctgggcccatcctgggaccccagatggggtaag

SEQ ID NO: 1554 - DNA, 545 bp, Homo sapiens
ggtgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggaaaaaaaaaaaaaaaaaaaaaaaaaaaaaaaa

SEQ ID NO: 1555 - DNA, 1141 bp, Homo sapiens
ggcacgagtctgcatcttgatgatcggtggtaggatacacagtttataaacgaacctgaggctaacaaatactgtcacttttcttaagtttacacagcctattggtggcagatctgggatatggatctgttcggtttcagagccctgctttcctttcactggaatgtgctcttcgctttagcccttttttttttttttttttggtttctgctagcctttatttgagaaaatttacacaaaaatccccaatgcaacatttacaagtgaatctgtataaatcccatatgcctgtttcccaaactgaaaaatggctttatgacaggggtccatgacaatggtataaaaatacttacttaaactgcatcattctcatttatattatacagaccattttggataatatgctcaaaagtggaggaaagcacataacacccctgttttttaagattatttgctcttgtatcagtcttttgtcaaaggcaaatacttttacttcttggataaaaccaaggtataatatcaattaacttttaaaccaaaagcacaaaatgtcctagttgatagttttggcatgagtaaagggaagggacatgagagaacatcagctcctacaaagcttaagtttagggtcacacttgggaacaaaagcatcaacaaaacaaaatattctcttctcctatcttcttgacattttgtcacatcagaagaacataactaacagagtagctttcattgctcctgaaaaggggaaaggcaccagtcagaaataggaaagaaaatcttgttaggttaatggtacatgatagaatttcacattaaaaagtttaatgatggaggatgggcgtagtggcttacactgtaatcccagcactttgggaggctgaggtcagtggatcacttgaggtcaggagttcaagaccatcccggccaacacggtgaaactccatctctaccaaaaatacaaaaaccagccaggtgtggtggcatgcacctgcactcccagccactctggaggccgaggcggaagaactacccgaacccaggaggtgaaggttgcagcaagctgagatagcaccattgcacttcagcctgggcatcgcagcaagactctgtcccaaaaaaaaaaaaaaaaaaaaaaaaa

SEQ ID NO: 1556 - DNA, 656 bp, Homo sapiens
gagccagcgtttaacgttcaaaaggcaaataactgatgaccaggcggcacattgttctgctccgtgagttctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagacagattcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctggctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccgtttctgtcttaaaaaaaaaaaaaaaaaaaaaa

SEQ ID NO: 1557 - DNA, 798 bp, Homo sapiens
tgagcgcgtggtgctgataccgccatggtcgcgggcttgatccccgcaccggccctagtcccagttttttgttggtttgtttctttgttttctccccatgaactgtttctgcaactctttttcaaaatgcgcctttcaggttctgtaagccccatgcgggcaggagcgacttgcgggatctcttggactcggcccagaggttgtcgaggacagcctggcagggaggagcgggagaaacccggccagcgctggggcggtggctcctccccggagtccccgcggctggggcaaagcggaaggcagccagaggcgcgcgggcttggcgaggaatcgctcgtggacgggcgcgaacgtggagcccttttatacgctccaggggcactgtgccgtcgggcggccggttagctcagttggtaagagcgtggtgctgataacaccaaggtcgcgggctcgactcccgcaccggccacggcgttagctttttttttttttttttccccgccgccaccccgccatgaactctttctacaacagtttgtgaaaaatgcgcctttcgggtactgtgagcggcgtgcgggtaggagcgaactgcaggatctcttggtctccccgcccagaggttgtcgagggcagcctgctggggagagcgggaggtaccaggcatgcgctggggcggtggctccgcacccgagtccctgcaccctccgccacctgcaggccactcaggatatccaaagcgatccacatctccagcctgggcaacagagtgagaccgtctccaaaaaaaaaaaaaaaaaa

SEQ ID NO: 1558 - DNA, 1221 bp, Homo sapiens
gcacgaggtggattccagagaagaaagtagatgggagcaagtgtccaatacagcaacagctggaaagaaaaataaagaattttgttctttacctaaaacacttcagttaactaagtgtgagtttaaaaactaaagacttgagaactttatcagagttaataagaacgagaaatatgtatgtacatttacaatacaaaattactatttaataatttacacatggcattaattctaattgtgtttaaatatcagagctttttcaggcttcattcatgtaatcaacagccacatgctaaggtactcgaaccagcagtggaattacaagatgaagatggcatggtccacctctcaacagtcataagctataatctaaaaaacagacaggcaggcaatgtctatatagagtcatatataccatgacagatatagagcagggcactactggaacacagagaagggacatctacccacttttatgtcatatcatgggctttctggtggaggagatacataggttgatacctgaaggacaaggaaaagcttcccagatagaggaaagaggcaaggcaaagagcctgaggtaaggaagagccctgcagagttccactccatccagtttggtgctagagcaaagggcagagtgcagtaagcggtgagaaacaagactgagtaacttgacaagaatcacattgacatgggtgtttttatttcatggtgaaaaatttggaacttttcctgagaacaagtgtaagccaatgacacagttaattagaggagatttaaaatgtcacctgtcaagtgactgcttatgaagggttattgctcagctaagtatttctgaatgagtcttaggtctgttggccttcaatctctaccaaaaccctgagaacttgatgatgcttttgttttctgagaatcgtttcagtgtgctggctgacagttccatgaggatggcaaaacttaagaaagtgtagagccaatgaaaaagagatgcacagacatcttgggaactgtttaagctttggaacatgatgaatttatggtgcataagtacagtcttctctgtgaaagtttttgttttcacatctttcattagatgtgtgtaagaaaaaaaatattgatgtagtatctactaacccaagaatgaaaaggaatgccatttgctatttacactttatttctaaaataaacctaaatttaattaaaaaaaaaaaaaaaaaa

SEQ ID NO: 1559 - DNA, 438 bp, Homo sapiens
cggcacgagccgacatctactgcgagaactgcaagaccacgctcgggtggaaatacgagcatgcctttgagagcagtcagaaatataaggaaggaaaattcatcattgagcttgctcatatgatcaaagacaatggctgggagtaatgtgcgaactttcccttctccttcgaatgctgttttgtgaaagaaactgtgaatgtaatggaaacgtaggagcatctggtgacagcctttcttgccctctgacctcaaaggctagctgcgcatagctcttgacactcccggccatctctgtgggtaaggtgtccctcggatctgtcctcttcgtgtacacagttgtttctgaaaattttcaatgagctttttctaacttctcaagttctagagaaagaattaaccaactgatgacttaaaaaaaaaaaaaaaaaaaaaaaaa

SEQ ID NO: 1560 - DNA, 442 bp, Homo sapiens
agccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccaaaaaaaaaaaaaaaa

SEQ ID NO: 1561 - DNA, 542 bp, Homo sapiens
ggcacgagcccaagttgattttttttagttttgaaaatcaaacaaagttcaaaaagtaaacatcacaggttgacatcccagcccaaagctgaggaaaaatgtctcttgttacattttttggcacataatagaatttatgagcattttcagtgttttgatttttttccccagtcactgttattccttaccctccagagttaggtgtggagagattatgttggcctgtttccatggtgacactgaagaaaagtaattttttaaaggaggtttctactgtgttatttcacatgcatgaaacatcaacatctatgctgtgtggctattacccctaaacataaagacacagaaatggttggagtattttatataaatagacaagtagggtgatattttccttggtctcgtgccgaccctagtaacaaaagtctctcagttacccagggcacctgggagagagtgagggaacagttctgttcagtgttaagcaagctcctctcctgtgaataaccttttctttaaaaaaaaaaaaaaaaaaaaaaaaa

SEQ ID NO: 1562 - DNA, 1060 bp, Homo sapiens
  misc_feature (1060)..(1060): n equals a,t,g, or c
gcccacgcgtccgcctcactgaagccaaaagaggggagactggagtgaaagtgagggcaaaagaggggagactggagtgaaagtgaactctgcttttgccctcactgaagccaaaccacagaagactttgaggaatgagagacaaatgaggtagagctcacctgtgctcaccagctccgtcaggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaaaaaaaaaaaaaaaaaaaaaaaaaaaaaaaaaaaaaaaaaaaaaaaaaaaaaaaacn

SEQ ID NO: 1563 - DNA, 1240 bp, Homo sapiens
  misc_feature (1039)..(1039): n equals a,t,g, or c
  misc_feature (1052)..(1052): n equals a,t,g, or c
  misc_feature (1063)..(1063): n equals a,t,g, or c
  misc_feature (1076)..(1076): n equals a,t,g, or c
  misc_feature (1175)..(1175): n equals a,t,g, or c
ggcacgagctcagcaggttaatgagagtcgctgtggggcaggcattgcaaataatggtgattgcatggtgcaccggcctttctttagtagcagaagcccttctgtgtaagggcaagagcagggccactgtgacaggggaggcccagaggcctcagccccacactgggctcctctgcaggttgcccctggacctaagagtgctacacctctggaaaacagtgtggagagcagtgctgtggcctggagggaggaggacgcagctagcaggcagttagtcggttccctgggcatttcctttgcctccataggcctccttgcctccagtgatctgttagcaggtgttgggtgatggtgccccctagtggacagtttgcacaagggcacccacactacctcagggcttttggttcctgcagtggcgggctcccccattgtcggctctgaggtacttctgagaagcctcgggaccagcccaaagctataaacgtagagctsgtgggctttgaagtactcactccccattgagggattattttcttctcctcagggtactcctaggaggccttgaattcttcggggcctctttagagtggggctggcctccctgggctccggtgccagccgggtgtagctactgggtgcacccaagattgtgaggaggggaggaggcgtgttgtgcacacgtgtatggggtgagaggcattataggtgtggcctggggatgccggcctccctctctccgtcaggaaagccagcattgttgccgcacctaggaggcagcaaggcgcggtgacaggaatgtgtcaggacacaaactcaggcttcactgccagctctgccatatgctcatggttacctgaagtgtatacaccaccgtgtgtttgttggctggggctgccataacaaaataccacagacgaggtggcttcaactacagaaacgttcttttctcacagttatggaggctgggagcccaargtcactgtgaaagcaggtttggcttcccctggggccgctctcccgggtttgtgctggccgnctttttggtctgnccttacatggnctattctctgtgngggcgccttcctgctgctcttcctcctcttataaggaataccacacacacacacagacacatacacacacacatatgccacacacacaccacacacacnacaccatacacatatgccacacacacacaccaacataccacatacacacatacacacacacacac

SEQ ID NO: 1564 - DNA, 826 bp, Homo sapiens
ggcacgagcagaggttaaactgagaggctcgtaattccctgggtcttatcttttactttaaaatgaaatggcatgtgctattttctagtcattagcatcattctctgtattttcagactatttaatagtcaaatgtatatgattctcccatgttttttaaaaaaaaatcttagtattatgtgaaatacaaaactagcatctcctttagttacagtattttttacttagtctaaaattattgtgattgtagtcattaattaatgtcctttgctattatgaaaatgaagctgtttgctttagtacttttacccatagaggaaatattttgtcatttataaagccgtattgctactacatatatctaaatgactttttattttttaattgttcttcattaattttagtgaatcttagtatgtgaatgtattactggaatatgaagcttaaaatggtttgttctatctcaggaatattgtaaaaaacatagttttcatactacctatgtatttctgtgatgtgtcttgtaaagtatagtcaaataaattattaataagattcatcattttagttatttctttttctcatactctacactattgacatctattttctcccataccgtcacaatttcacctttagctagttcaccaaagagcccaatattatattttcatttgactttaagaaataaaaagaggtcgggcatggtggctcacagctctaatgccagcactttgagaggccaaggcaggagggttgtttgaggccaggagttcaagactagcctggtcaatgtagtgagacctcgtctctaccaaaaaaaaaa

SEQ ID NO: 1565 - DNA, 1174 bp, Homo sapiens
ggcacgagcacatgtcaaggtgatgacgcacttccaaatgggttagacgttacctttgaagtaactgaattgaggagattaacgggcagttataacaccatggttggaaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtct

SEQ ID NO: 1566 - DNA, 1502 bp, Homo sapiens
  misc_feature (477)..(477): n equals a,t,g, or c
  misc_feature (496)..(496): n equals a,t,g, or c
  misc_feature (513)..(513): n equals a,t,g, or c
  misc_feature (1279)..(1279): n equals a,t,g, or c
ggcacaggtcatctctggcaggaagattggagaaacggactcatgccatggactgtgatttagaatggaggacctcatttcagcttccttgcgctgaagtggagggccggttttcacatccagacttagtatgccacacacagacacacacacaccggaaacaaagttttatgtaaaaatatttttgcttactgcttactttaaaaagcagtttccttacgatatgatacgcactgtgatattttccactctattcctttattcagtgccaggcatgacctactccatagatttcatgacccactaatgggctgcagtgtgaggtttgaaacctckgcccagaggcagattctgcatgcttatttagaggaatgtctgtctagacgagagagattcatagaaaggagatcatttatggraaaatmcagatattcatggactttatcaccaggattctactttgtttctcctcctgcnttcattacccaggcagranctgtatcttcaaatgcntcgtgggtctgcgtacaagccctacaggtgccccaaagccatgtgcagagytaagcaccccatttttctcataacttgacccctctgcctgragctctactcccgctcctctggccctcctctgtgctgccctcccaaatcgccccagctaaaaatgttggcagtcccttccatacctgtctttcttattctgcacatccgctcatctcaagggactattgattctgcctctaaaattgctgccagctctgtgtcatcttttccattaatatagctattgccttcatcatctctaacctggagaacaggaagagaattcctcatactctccctggtctagaaggtgacagaggggctgtttttgtggggtgttccgatccaacctgatcatgtcctttccccctccccaagccctcagcatggcccctgcagtctcctcctcagcacctctccagctatggttcttctctccttgcacagtgcagccatttattaaccatgtcgtctactgaattcaaccaaacagagctgtatattttctctgtatcaggaaaatgaaaamgcctccaccatagaatcttaaaatgtgtttctttaggatcatcttagccactggttctcaaccatcattacacattagaaccacctggggagccttaaaaatacccaaccccggccgggcgcggtggctcacgcctgtaatcccagcactttgggaggccgaggcgggtggatcatgaggtcaggagatcgagaccatcctggntaacaaggtgaaacccgtctctactaaaaatacaaaaaattagccgggcgcggtggcgggcgcctgtagtcccagctactcgggaggctgaggcaggagactggcgtgaacccgggaagcggagcttgcagtgagccgagattgcgccactgcagtccgcagtccggcctgggcgacagagcgagactccgtctcagaaaaaaaaaaaaaaaaaaaactcgag

SEQ ID NO: 1567 - DNA, 814 bp, Homo sapiens
  misc_feature (480)..(480): n equals a,t,g, or c
  misc_feature (504)..(504): n equals a,t,g, or c
ggcacagcggcacgagtttgttcattctttcatgcattcacctcttattcagctaagacttcagctgctgttatgtaccaaagggtataggaacccttcccagtcttcctgagctgctcctagtccttatttagttcgttttttataccaatatagctcttcttcctccttgtcctcttcgtccatcaccacttcgtgtttttaggcttactgcaaatcccaactttcttgttcttgttttggtattgcaagcttgccggctggctccattggctcactcattatcctctccatcacattcttttcttcacttactactgagtgatgcatatgtctgtgtttgtctgtctctcctaatttagatttgattaacctgtatccccagtgccctggcatatagtatttgttaagtaaattaatggataaattcagaattgatcccttttttgccttctgtgctttattctccattatgttatncccaccttgtgctattgaaaaaanggaacttcaggtcaggtgcagtaactcatgcctgtaatcccagcactttgggaggctgaggtgactggatcccttgagcccaggagtttgagatcagcctgggcaacatggcgaaaccccatctctacaaaaaatacaaggattagctgggcatggtggcatgtgtctgcggtctcagctgaggcaggaggatttctccagcccaggaggtcaaggctgcaataagctatggttgcgccactgccctccagcctgggcaacagagcgagaccctatctcaaaagcaaaaaaaaaaaaaaaaaaactcgag

SEQ ID NO: 1568 - DNA, 1303 bp, Homo sapiens
ggcacgagagttccacctaaagatttctccatacataatgaactctaacttaccggcatgtaaacagacctgacctactcttgtgccaatctctgagtttcagccaatcacaggcagccaactgtttaatccctgttcaaataaggtaaatgccaagctgtaaccaacccagctgtttctgtacctcacttccattttctgtacatcattttcctttttatgtccataaatcttgtctatgtggcagctccagagaatctctggacctattttgattcaggggctgctcaacttatgaatcactgttcaattaaactccatcgatttaatttgtctaaagttgttcttttaacaccagaataatgtatatcataatctccctcactctaatcatgtggagattcagattttttcagctaatgaggctccaaccctgtctttgtttaaaaaaaatgaaaaaacaaaacaaaaccatgtcctagttttactgctaacagtatttctctgacttttctggatttcagttttgtacaatttctataataagaggttaacagacattatatgctagcctcacatgaatattacctcctgatacctataataatatgaataatatagagttatgggtaaggaacagacaacttattttacattcttgtcttttcctctccttttccttttcaatcttgccagcaaatcttgccatttaaaattttatatttaaaatgacgtatgcatttttctccatagggaatattagtggtctataaactagtcagtatttcttccctacaataaagcaaaagcagtagaggtcttttgctgtatcctatcaaaccagtaataatccctctgccaaaatcatcatctgttctgagtgtctactttttcatttgtctgatagctcctcttggcatatagtactctcttttgaaccttctgccaaacaagcacaaaataggacaggaaataaaaactctgaggccaaggtctccatggcccacatccccatctgtgagagcacaagagctattgctctcctcactaaagattgcctgatctatttgttggtctccaacaatttcctgagtgtatctgaatgaatgcaagttatttggaatgagtggttgctttttagtctcaatactggctttatactctacctctcgtcttttcctgttccatctcctatcatcctttttttaaagggagcatgtggaagtgaaaggacacggcggagccagaacaagagtgactgagttttgtctccactgcttacttgataagtgaccttggacaa

SEQ ID NO: 1569 - DNA, 1522 bp, Homo sapiens
ggcacgagggcatagtctttaagggctgcagactaagttcatctttgtgctcccgtgctgcttccatttcaaaggcttcgccagcgaatcccgtgagtcattcctggaaccttcaggagtctccatggtgatggggttgagtgggcctgggggaagccagcattcactccacttcctaacaagttcctcttttctgatttttttttcttttttttcaatagagactggggctgaggcttgagcttttttgtttttttaaacaaatcacaaaataagaatccctaagccttctttccccatttttttggaaacccattctagataaatatataatctattcttacttgcctctgttgagaccatataaaacaacaaagcacaacaaaaactgtgcatttgctttctttttttttttttcttttcctgcaagtgttttcagaagggatctggttttcttgttttcctcagtgaaaagatgaaaaggctctgggtaactgattgtagcctgaagcagagatgccggcagcatcaagcccagaggaaggcaggcctgtctagcctactaccgcccctgtggaggtctaccaggagcctgaaaattatgcccagtcatggttggcagaactgtgcatattcttataatccccacctctccttcattctgaaatgctctggaagarcgtagtatctggggtttgttagggaacgagcattaacgttaccattttaggtacaggaaaatgtagctaaatctacaggcatctatgggattttccacatggtaccaaaaattaaaatttgaaaccaatctaatgtgaattgatgaacataaataatctttgggggtataaattctgtgtcaaattccataatggtgttgtggccccaaagttcccacacctgagggtgaaaatgagttttcagtaacattgaaaacttgaattctgctgacttcgttatcccctcaggttgaagcaggacgtgcagcttcctgaggttctgcccccagatttctgggggtcttgggggcattctcaccatgtgctcccactctggagagtgcagccaatctctgctggtagcttaaaattgccaaagccttgcccggggctggggaaggaggtggggaacagcttttctctgctgtgttagtcgctgtgtggggccccacagcaaggctgcttgagccttcattgaccagctatctagtttttgcttccagtctgctctatcctccctcagccccagccttgcccctccaggagcacgccaggttaaagccacatctttgtatttggaatcctactttgctctgacaactgaggcttttctaacaggtcaagctcaccaaatctcattctgggttcttacagcgtggtttcttaagctgtgaaaccttttcaaaagatgataaaagccccagaaattctctcagaaaagtgaacatataggtaacatttcacagacaagctcaggagtttctgggccttcaggagagaatccttcctcacaggaattttct

SEQ ID NO: 1570 - DNA, 1572 bp, Homo sapiens
ggcacgagaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggatgggatggggtgtggtagcaaaaggagggagaggagtcctttttgtgccaaatccctaagtgccgttcgggggccatgtgtgcagcatgactctccctgtctgtggcaggacccaagcgcttgcttaagccccagtgctccatgccagcacttgaactgtctggggtttgatggacagagctgaggaatttcctggcttccccagatagtgtcctgggacatggtatgctttggggctggggtacatggaatccctctgaggacctggatactggtactacggggtggggaagagaaccttaaacttggctttccccagccttcagcctgagtctagcatgtttctagctccccagtcccttgtgaagccttgaggctggcagaagggttaggagttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggatggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgtaaaaaaaaaaaaaaaaaaaaaaaa

SEQ ID NO: 1571 - DNA, 1631 bp, Homo sapiens
gatcccccgggctgcaggttcccctctatgtgtccctgtgttgtcatcatttggctcccacttataagtgagaacatgcagtatttggttttctgttcctgtgtaagtttgctaagggtaatggcctccagctccatccacgtccctacaaaggacatgatctcgttatttcttgtggctgctactgacatagcatctatcttgaaattcatttcattcatgcaaagttgtccagcgcttacacagaacacagagagcagagttgggccaaaggaccttagcttttatcatgtctcccttttttttgactgtgctaaagcattattttgcttttctgtttgttaccaaatcctttatcttcaatggttaattttttgtttatatatttggttaaacaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagaaaaaaaaaaaaaaaaaactcgag

SEQ ID NO: 1572 - DNA, 1902 bp, Homo sapiens
ggcacgagatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaatcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatggttaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgaaaaaaaaaaaaaaa

SEQ ID NO: 1573 - DNA, 2054 bp, Homo sapiens
  misc_feature (428)..(428): n equals a,t,g, or c
aattcggcacgagtagaaacgaaatttattttaaagcagtagatggtggtggtcaaaatagtaatgaatagtgatcagcacccaagattttcaaaattatgtcaaacacagtgtccaagcagtaatatgggatttaaaaaaatacatttatgggggatgaaatgagcataaggacttggtcatccacacataactactccactgagtaagaagttccgtctctcccacggctggtttgtccccacttccggacctgtcttctttctctgttgcagttggcaaggtggaaggtttaaggaggaaagacttacacaatattgttgtcatgcaacagagcccgtgcatgtaaatgtattatgtgcagaaaacaaacccgcttgtgattgcgatggggactgtttccataaactttttttttttttacaagnaaaggaaagtctattgaattttaaagagccagaaaactgccggatgtgctgacagctagaggtgtcttgggtacaaaacacgccaaatgagccttccctgcattcactctaatatccttcatccaaaagcaggtctttcttcttaaagttcagttttcattatgacatagagatgcatcttggtaacaaacagttagcgtacgtaatcttattaatcttactgtgtccgtcagttgcatttttaaaatagtggtaggcgtatctgcaaacgtacacccaacgtctctgagaaggatatgggctcatccagtcttcatcacgagatccacatacatctcttcatctgagtactatcacacagaaaagactgacggcttgtgacaattgtacaacattgctctttacccgtacatagctaagcaatgttgatatccatgttagtaaggactcaacattcattttcaggtgtcgtttcacttttgattcattttctctctgtgtttatttatttatttatttarartcytgrtctgttcattcattcactttttaaaactaaattataagaaaaaagtgtatatatcggaaatgagaaatataarataaatatcattactactgagaaattgtactgkaattgagragggagaagtkgttkgtttccctttgatctyccccagsacttagcaaaaagccttttacagaaaaakgaagataaacattaataaacaggttgatcagttaaatggtttaatgaaacaaattagtacatctatggaactctttttccatccgtgtttgctaaatcagaggaatgactaattacagagtgctcaggctaattaagaggggactggtaatgtcctaggagaactacagataaggttaaaatcatgtccaacataaacttctgttcccttcctataagcaaagagattaaatgtgtttgggttctcaaaaatcccaggctcacatctttacatttctgtggacaaccaaaaagggaagcaatcaagggtaatagatactgtgtaaactgggttaaaaaatccgtacagtgccagggatgtaataaagatggtctttcattctgtgaaaatataatgaacttcctcaaggcaaattacataatatcatagaactcaatgtttctgctactatcgggtaaggtgaccatacacagtcgggagsctgtggctgcatgcgaggtgtatgcttcgttcctcagggttattgctgcttccctcatctcagctgagcagaaatattacctagctaaaaaagacactctgggctcaaacagatgtgaaaaacacagcaaaactaggacgtgatgctcatctttcttttctttcctttctcctttggagtgacacataaaccaagcagtcaacatttttttttttttggtgtgtttattcaagtaagcaaagcctttttcgtatgagaaatgagaaatgagaaatgtgcctgcttctcatgactgatagaaacaattccgcatgtagtcataagagccccagttcaaggacgtgcctattttagtacaggcctttgcagaacgagagataaatgacccactcagaacaagaactcaggaccaaaaaaaaaaaaaaaaaactcgag

SEQ ID NO: 1574 - DNA, 1003 bp, Homo sapiens
ggcacgagggcatgttattttcatcgcaaagttactgtaagctgggagaagtggcacacacttgtactcccagctactcaggaagcttaaggtgagaagattgcttgagcccaggagttttgagaccaacctgggcaacacagcaagaccccagctcaaacaaagaaaaaaagttattgaattttttatttctatggatcattttttgtagtttcttattcctttcacccttcattcccacttttgatcccatcttttatttatttagttttattaaatgtatatttgtctgataattctgctatctacagttttttgtggacctgactcagcatttctttgtttcttcggattcagactgttggtggcttgtgattttagtgatttttggccgtgaacatgtttcttggacttttgtctgtgggaattctctgtgtactctgtataaattaagttacttcaggtgttttgcattttcttttgccatgcacctggggcctgggtcactacccttctggtaccacttaaaactgaatttttgtcttgggtgctcgtactgatcctgtatgagtacaggtttatacttactgtagaaatatggtgtttgattatggggtattgtcccagatggtgctggagtattaatatgctctctgttaaacttaatgtgttgtccctgtaaaactccaaaattctgaattccagaatactactggccccaaatgtttaagataagggcactgcctgtatttgtttctgcctcccactattttccttagtttaacacaaactcacctttttaaaaaacattttgagagaattcagtattgggaagagtttctaacctgtttctggaaatggaagtccaaagtctgtttctgtaattgttttttttttgagatggagtctcactctgtcacccaggctggagtgcaatgacgtactctcagctcactgaacccgggaggcagaggactgcatctcaaaaaaaaaaaaaaaaaaa

SEQ ID NO: 1575 - DNA, 1832 bp, Homo sapiens
ggcacgagaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagagggagaggtgtagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaaagatattgccatacaattttaatttatacaagtattggcccctcaagtggttggaaattttttttttaatctctttttctgaacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcatcttttgtaaaacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcctctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgcttggcaaaaaaaaaaaaaaaaaaaaaaaaaaatggagctattttctgtctatataaatctacttatatgaataaccattaaagtgattttgtataaaaaaaaaaaaaaaaaaaa

SEQ ID NO: 1576 - DNA, 2352 bp, Homo sapiens
tcattgtatcaacagtacacttgatctccagtacagacatatggtggaacagaagcctggatacaggactcagactcttactgagttggccaggagcagcaggcaccacagcctgtgtgtgtgcagatacagtgtactactaccaaatggtgcccagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagattgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatccagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaaaaaaaaaaaaaa

SEQ ID NO: 1577 - DNA, 1050 bp, Homo sapiens
ggcacgagtttacaggcagggatataagcataaattttcatgtcaattctaaagtcaatgggatgagttcctaactagagtcagaaaactctgttaaataataacacttctttgcatttggaggatgcttattttccaaatcatttcacagcaattgccttatttgcttcttgcaataaccacaggaagtcaggagagcagatatttttattcctgttggacaaatgaaaaaaaatgaagcatggaagagttaattgaatcacctaagattccacacacgtaagkggmcagagttctagattagaaactctcttctgattctcctatgctaggtgtaaaagagtagtcaagagtggttataggtacagcttaagacagacctgtactgaaatccacttgagtccggctacaacttgtccaggtggatcttgagtatttttagtagagacgggggggttcctcacgttggccgggctggtcttgaactcctagcctcaggtgatcctccctcctcagtctcccaaagtattgagattacaggcatgaggcaccacatgtggccaatagctgtactttccaaaaatgtccaagtcaagaaagacaaagtaaggctggagaactgttccagattagactaaaaacacatgatcctgaattgaaaaaatatgatcctgaattgaaaattatcttgagaactgaaatgggttaaatgaatactatttagacaattgccaaaatttgattatggactatattcgtttcctacggctgctatggtgaattaccacaaatttggtggcttaaaataacacacatttattttcttatcgctctgaaggtcaggaggatgaagccagtttcactgggctgaaatcaagatgttaacagggttgaactccctgtggactggtaaagcacacattatctccagtttactcttttttttttgatacggagtttcgctcttgttgcctaggctggagtgagctgagatcgctccaccgcactccagtctgggtgactctgcctcaaaaaaaaaaaaaaaaaaaa

SEQ ID NO: 1578 - DNA, 746 bp, Homo sapiens
gggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacaggtgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtaaaaaaaaaaaaaaaaaa

SEQ ID NO: 1579 - DNA, 2608 bp, Homo sapiens
cccccgggctgcaggattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaagaaaatgaattttattttacttgtcacacctgtcttaataaactggagttttgctgctaaagaactcttctctctgggggcagagcttctatttatggcacatagacatcagctaggcttttgggaatcgtttgtgttctttgtggaaatgtcctttagaagcacccatgaagtagtgtgttcagactgtgcacacagaaaacaggctctgccttcacatgtgagacggtggacttttcctctggacaaaatgacagcatcctggcgactccacagtggagctgagcgccactccctgtagccgatctgggactgaaacgcttacacctctgcctcagaaggagtcccccatgccctgcctgaaatgacttcactggacacagcggggctgcagctaacggggtacaggtaggagctaactaacttcacccctgagtccacttgcggggtaagagataaacagtaacccttccaggagcccactgacgttggagtgctaaaaatgccccttcagggggaaaactgcattttctcttccaaaaaggaaaggttcttccaggcgagaaacctgtggtctagaaccacagcaagaagaggaggcatgctggcctgcaccggaagactcactttgtctgccctgcgccagcctcacctcaccctgcagttcccgtttccgccatggatgcctcatcaccaaccctgaccttccccctcccaaccctttattcatcctcactcccactcatacccgcctccctggacagttccctgctgcagagttctttctgctttcagccctaccttggtggtgatttacctgaaaatcttcacaactgatcattatctccttctctttgagacctgactgaaaaaattaggtgtgcacacctgtaatcccagctacctgggaggctgaggtatgaggattgcttgagcctgggagtttgaggctgcagtgagctatgattgcaccactgcactccaacctgggtgacagagtgagaccctgtctcaaaaaaaaataaaataacataaggaccttaaaaaaaaaaaaaaaaaaaa

SEQ ID NO: 1580 - DNA, 1067 bp, Homo sapiens
ggcacgagaaataaataaataaaataataataatgataatatgatagcagctattattttatcgagggctctgccaagtgctttatatgcgctaggctctataatcttcacaacaacctttaagaaagactctgttaccatcttcaatttacagatgcagaaacgaagcacaaagatgtcatcaaagtgtctgaaggtcacagggccagtaaggccatgggaaatgtgcatgttaatctgggctctttccattctgctcattgcttctcaccttcccttcctttctaggtaccagggggaacagagtaggtagagactggtctcaggctgcctgaaggctgacacagacccagccctgaccctctcacaacgtcacactgcatttgcccccagctcctctcagtctagaaacctgcaaaccccaggatcctagtgtctaagcacaggccccagtgtctgttaggtcaccccattccaggcttggatctagccccaccccctccctcacatctcccacctcctcagtcaaaagcaaagtcaagacaggcagccaagccagtcccagcagaactccttgagaaaggtgacatagcagcagcaacccagcctgagaaagtgcctgaagccacagcagccaacctgttcaaacagatcacctcctcctccaccaaaaagaatttacctggaagggtggtttcaaaacaaaagtccaggaataggtgaaaggtctactcagggaaactaaggatgggaaggaaaaaaccactcctgaaggaatgaggtgstcaccctataatcccagcattttggaaggctgaggctggtggatcacgagtccaggagttcgagaccagcctggtcaacatagtgaaaccccatctctacaaaacatacaaacattagctgaatgtggtggcatgcacctgtagtcccagctacttgagaggctgaggtgggaggattgcgtttaggagatcgaggctgcagtgagccgtgattgtgccaccaccacactccagactgggtgtccagagtgaaacctagtctcaaaaaaaaaaaaaaaaaaa

SEQ ID NO: 1581 - DNA, 2466 bp, Homo sapiens
  misc_feature (1348)..(1348): n equals a,t,g, or c
  misc_feature (1449)..(1449): n equals a,t,g, or c
  misc_feature (1457)..(1457): n equals a,t,g, or c
ggtgagcctctgcacccagccacagtggtgactattgaacaaaactgagtaatagtcacatctcctgctcccttgaatgcagaagcaattgtacttcagggcatggtgttatctacttgcaaactttttattttttgatcttacagcaactacttttgatagtacctcactaaaaacatcagcaaggagccgccaatatacattgaccactctggttctaactgctttccccatagctagtctgcctttcaaattgttgctggtgtcagttttacctagtgattggtcaaaacataacaagggtctctagtttttcatcctgcaatatctgtttccacactgccggttgcctggcaacacaataccagagccacatattttagatttttgttatgatggcacttttccattcctacgtatcagtcagctagagctgcataacaaatagcaaagactgggtggcttaaacaaccaaaatttgttttttaacagttctgwkggccaaaagttcmaggtcaaagtgttggcaagtttggtttctcctgaggcctctctccttggcttgcagatggctcccttcttgctgtgtccttacactaggcacttgtgcccctaatgtctccctgtgtgttccagtgttctcttataaggacaccagtcttataagattagggcccctctctatgatttcatttaaccttaattatctcctgaaaggccctatcttccaatatagttacattggggctttggccttcaacctataaattttgggggtctacaacttagtccataatattctggtactgaatttaaaactattagggtgtcggctaagccactgtaacagagaaacccccaaatactgtagttccaataagataatttattttctttcttgtagccatcaggaggtagcccatgaaattgtccagggacttatatttattctaccattatttttactctattattattttatattattattatacttattctaccatttattctgccattccctagagtgtcctcttcatagtggtcaacctgtgggatggagaagagaaaagtaaagggcaagcacatacatttgaataaaatgagatagaagttgcacacatcaagtttgkatattcttttggtaagaaattaactgcagaggaacctcttgctgagcagccatgccttctaaaacctgggacagagattttattattaaaatgaggaaagggagaatgaacgggggggaggattatcagttccttcctacattcctcttctatacatcttacattytgtattgagtatgagaagagacctgaaatttagatgattctttacattnttatttatctaaaattgaagtttacctaatttagtttaatttaattattttactgatttaaattaatcagattttcttaaaattccrgtaaaagaaaaaancgtaaggnaagctttgttgctttgcaaaatagggagatatttcagaaggtaagggaagaggtctatcctacagtatggagtacagaagtgggacttagagatagccaagagagtttgaaatattcaaagaatatatccaatataatctgtagccttttttaaaaaaaaaattagaatttccatctctctgaatgtattccagttgtaaaaaaaaaatgtattgagtttcccatcatatggaagtttttaaaattgtaggaaataaaatattcagaaggctacacaaggtattaaaaaaggggacagggatataatagcttactagcttattagaatgaatttggttccttatgagggataatctagagaaaagaggcatagaataagatctttggaaccaaacagtctgagtttgaatcctggctctcccttttggcatctgtgtgatcttgggcaagctacctaatttctattacagctttgttatctcaactgtaaaatgaggctgatattgatatatcattggagaggactaaatgagaccatgcaaaatgtgtacttggcacagtgcctgatccacaaatactgatgatgatgatgatgatgatggtggtggtggtggtggtgatgatggtgataataacagtgatgatgatggtagtatagcattagtgcagcaaaaaggaaaaatggactcaaaactaatttttcctaaaaatttgtgcttttatttatcagatgcttctaacttagtccccaccagtctaagactagaacaatattgggattttccttttcagaagttctatcaytggcaagttgtttttatttccagaactccaactcagaagaaatcacctctgaattcattgtctatttaataaagtcaagattcttcaaattctccattttattcagtattaaataactttcaaaatatggctatcttgaaagtctccacttcctcatacttagcaatttccagcattatttaaaaaaaaaaaaaaaaaactcgag

SEQ ID NO: 1582 - DNA, 2549 bp, Homo sapiens
ggcacgaggagctgctccccccagcccactcctacctcactccatctgcgctcaccctgttctcatcctgccccactgtttgacttgactcccagcacaggcgccctggcacagcagggatcttgcagcgattccggttgcacatccacaggggcttctaaagaatgcactcaggacttctggcctcattcccaccccatggaccttacctcacccttttctccagcaccattgggccaaaatgagaccttatcaaagaaagaacaggacgcttgcctttttcctcaggttcttaattatgtttttagttttttgcgagtctctctgaaatcctgaagatgtggaagagtttgactaaagtacataaatactcagagctctttttttttttaaacatccaggatctcaagggtgttcagaaccttttcaaaaaaataatttagccatagatgagaagcagccactaggcccttccttgtaaagtggcccctgtgtggggatgcttcaagccaggtggaaggacggctggactgtgataggagtgagaaaagaacagatctttttctttgagggatgtgagcccccttagttgtcagacccagagaggcattgaaatgtgacagttgttacgtttcactccccaccctgacctaagtaatcgcctgctctgtggactctaggccagtagcctgtaaactctgtatattaattttgcctcagtttctttaggtcaatacgaacaacagagcggtggctgactacacataatgtttgggatcttacctgaagagcttctgcaaggaggcttccagatgtttaaagtttggcttgagttggggtgtcctcagaccccactgacatggagtagtcctcattctgagaacttggtatctgttatgagacatggtttggctgcgtgaggtggtgattggcttctcaccatgacaagccaccttaggctgccaggagaagctcttcctgggggaggggctgcccctaggtggagtggaaccagatgttggggtctcctgatcacattttctgctttacagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgcaaagtgagacttggccactgacctgggcctgctgcaggagctcttcagaaaggcacatgaggaccacggtttgctcagtttctggtaaaacacaagtctggagtgcccctgcaaagggtattgatggacttcctgccagtgacagagcatgtctattgcaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaaaaaaaaaaaaaaaaaaaaaaaaaaaa

SEQ ID NO: 1583 - DNA, 1068 bp, Homo sapiens
aattccctctcagcagaacacactaccagtgaccatccccactgtagggttagctgagaggccctattaggtacagaaatggctactattttaattttgtccatgcatctccatttacttcaagcttctagtaaaggtctctgtttctgcactctcccctccacatttctatacgacttttaaaatgtagtttttttcaaatcattttcccccatgatattttctctagtatctctacgscacttaactaaattttcctttgttcataatttgttagaacaaatatttactgagcatctactatgagccagatgaatgttagacttactagaaacacaaccataaataagacagacaggtagctgctcttggaatccacattacaatagaaagacaaaatgcatgattagatacacagacagataaagcagtcaaatgaacaaaataagttttaatagtacacacaggaaaaaaggagctgagacagagaatwacaaatagggcttgaactgtgaactggggacagaggaagctcttctgataaagcgaccttgcaatgcaacatgtataaaggagctgactacaaaactgggtttagaatcaggaagacggggcagagttctcagcacaggccaagaactaaaggcagaaagagtgtagccttggggacgtggaagcctagagcatttggaagacgcaaacaagggagaggggagcagctgacaatggaagggaaggggaccatcatgcagcacactggacctgggtcagcaaacttctgtaaaggggaaagtagtgaatgccttaggcttcatgggccgtaaggtctctgccacaggatccaaatctacagctgtagtacagaggcagccactgactacatcgtcagatgaacatgcctgtgttccaataaaacggtatttatggatactaaaattgaatttcatataatgtaaatatcatgaaatagtaaacatttgaattttttttttctcttaaccattcttacctcatgggccattaaaaaaggaattcgatatcaagcttatcgataccgtcgacctcgag

SEQ ID NO: 1584 - DNA, 1546 bp, Homo sapiens
cgtaaaataaactgatatttctgcagctctacgctgtattcagcgctaagagcaggtagtcaaactgtaaagcaaaccaggtgtcatgactctgccttcctggttttcctgctacctctctgactgccccttaagaggtcctctctctcctcctgtcctctcatttttagtttccctcaaaggcttagtcatgggcctcagaccttctaaatatgctcctggcttcaattatcacctctatgcagctgaatccaagtctatacagctagtcctaaattgcacctgatttccaactgtctattaaggcttcctctcttaagtgggaaggtcatatcctatggctcccaaccccatatattcaaattaaatgcacaatctttctgctcctcatgctccacaaaccacttccctttctaagtgctcaatttctatcagctattaaatttatatcaaatatccctattatttctttatcaccttggcctgaaacctcagtattccctttaccactacgcctcttgtagttttcttaataatgtccaatgtcctccaaaatgtcacttggattcacctttcctcctccttttcctcacttcattcctgtgattgttttctcgctgtatttattttctcctccatttgattcattttcactcaccatcagacccatttttctaaaatcgttttcatcaaatcaatctctctgcacaactcaagaaggctcaattgaatcactactgattgcagcctcaaggctaaactgttgtgacagactctcaaagccatccataatgtgccccctctcctctccccagttatctaaatttatctccccttcattccaaatcagtggttctcaattttgctgccgagggacatttggcagtatctggagacatttttaattgtcatgacttggagtaggggggagtacaaccacatctagtgggtgaaggccagggattctgctaaacatcctacagtgccaggacagcccccaacaacaaagaattagccagcccaaaatagcaagagtgccaaggccgagaatctgctccaaatcaaggctctctgtccccagaccatgctatatctatacctctgctcagaatatttccctagcaacttagaatgtcgtctctcttccccttaactatcaatgttttatttatcttcaaatcccattctaagtctatagcccatggctttaaataccatccagtggtgacgcctccaaaatgtttatcttatcttctgagttccttacccagctgcctactagacatctcctgagtgtactatttaacatatctgaacctgaattcctgactcccccaaaactccttttcctcaaataggtatacagccccagcaatcacccagttgctcaggaaaacaggtgggagttattctggatgctctcctcaacgttctctgctccagtgtcttgccacaaatcaatccattagcaagttctgtcaagagtctacctccagacacatcttaaatccaggaattcgatatcaagcttatcgataccgtcgac

SEQ ID NO: 1585 - DNA, 1392 bp, Homo sapiens
ggcacgagggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaakttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttascacaagtaattttctgtctgtttcatcactccctaaatactttctcctcaaattatttttctctgtcaccagattacattaagaatttgtcagataatgtgtagaactgcataacaggtaatagaaagtagtaatattatattatcaagggtttatattttaaagatctctctcactccataaaggggaaataccaagtgtttcttgt

SEQ ID NO: 1586 - DNA, 1250 bp, Homo sapiens
cagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatgcccagcccaccttataaatcatgcctgtttagatgtttgattttgttctgtttgctattgttatcttaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagaattccgtgtctactaatgtttcacctgcatgcagccttcattaattttgtagcaaaatataaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcaaaaaaaaaaaaaaaaaaaa

SEQ ID NO: 1587 - DNA, 2107 bp, Homo sapiens
ggcacgaggagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtttaacccaaactggtgctggtctcaactggctttgatgctgcacggggggatccgcttgggggctgccaggtgtcacctgaaggttatgcccacctcacccacctgctgatgggccttgccagtggccgcattatccttatcctagagggtggctataacctgacatccatctcagaatccatggctgcctgcactcgctccctccttggagaacccaccaccctgctgacctgccacggccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaagttctggaagcaggcatggggaaagtcacctcggcatcatttggggaagagtccactccaggccagactaactcagagacagctgtggtggccctcactcaggaccagccctcagaagcagccacagggggagccactctgggccaaaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggcccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaaaaaaaaaaaa

SEQ ID NO: 1588 - DNA, 1174 bp, Homo sapiens
ggtctggcaaccagtgacgatacagaggtgtcttatgatttcgtttgcgttttcctggttaaacatgaggtggttattgcttgtgtttaatcagatacgctttactgtcataagcctaatttgcatttattatctcttcgctattattttgtacaggatcttttggattcatgttcttgcgtgattgatttctcaggaactttctgagtttggttttggtgtgccagctccacagaatgagctagggagagctttctctgtttctatacctgaatgcttggtgtaatattttaaattaggtatatgattgattttgagtataaaaccagccttgtatgtcagggataaatcccatgatgtatactctttttgttgtgttgttgaatttggtttgctaatattttattgaggagttttgcatcaattttcattagagaagtgggcctttagttttttgtttgtttctgttttgtttgtttttgtatttgttttttggaactgaatgaagtgcactgtgttctctcaaaggagatttgcgttgctttctaggggtttgggtgcacaaatccacagcttccggccttttaagccacttgtcaaggtcactctgactgcagggccagcagcctgggaccagtacagaccatcacggcacaggcttcctgggctagtcggagaaggtgaagctcgcatagtggccagggacttggcctttctgccctcacctccctgaggccacacaaatcctcagcctgtgtggctggaggtgccgccatccacagctcacctcagtttcaatatcttgtcctcattttcttttccctttttacaaaatgaagcacatatttcttctggcttttgtggcgtttctctgtgggagaggccatctgaatacctaaccagtgtgttacccagataatgaaagttagcattcactttttaaatagcagtaccctcaaaaaaaattgaaaaagtcctatgtagtaatgatgctaatgaagaattgaaagtgtttattaggtaaataatatggtcttgcacattgtttatgtggtaaagactgatttttgtagtcttgtaaaagacattttctgttcatttacttttttcattataagatatgtataaaataaaacttgccattttaaccattaaaaaaaaaaaaaaaaaaaaa

SEQ ID NO: 1589 - DNA, 2029 bp, Homo sapiens
gaattcctcccatggagacagaatggctttcttcaaagtcagttaccattttctgattgctctgctcacttacaattggacacagccaactctaagtgcctctgtcaatagctaaaacttcctgtcacctgagacaacagacatggtcatccagacagcaacataaagttcctccacagctcttgatgctgagaaacagagagccatgctgacttccttcttcttttcctatattgctctctttcttgccttagggttttaaattatcttagaaatcaccacttactgcttacatagatcagtacctttcaaacatccagccctccaaaggaaaggcttttgatagctaaagattaatgactgtatattccagattttcaccctaataggtgctcaataaaaattacttaaacttcatcaagggtttatcttgtgttattctttaatggcaagtgcattgcatgtactggtgaaaatgtttaaaatattttttcaaaaggaatcagtattcaattttacattaggttggatggcagtcacattacaatatgacaatattaattctaactcttctatgctagacaaagacaaggtttcattttcttacttaatgcactgacattttggtcaatgcccattttaagtgatgacaagaatgcttcttaaatggtatactgcttgcttactattggctcaaatataaactcaatcttctttaggatgaccacttaactacaatatcatcaaaacactgcaagtaaataaatgtacgttcctcatcacaactcctgaaggaaatttcttactgatcatccttaacgtaaggattcaaagatacaaagaaaacttaagaaattgaaagttctatcctaaaactatcacctgtaagggctggttaaatatatatatatgttaattatagagcactgccacataccacaataaacttaagtagaatacaattatcttaggacagtgcctacttggggaatcttttagtttaatctaacaaacacttattgagcacacattaaataccaggtacactgttactcattggaaatatgaaagatacggtctttcccccactgagaaactcagaccaatataaatggctgttgtcttgggaacgtaacaccagatgacatgctttgaatatgaatgtaaggaaaacaaatctacttttttcttataaaaaaaagtcccattttaaatttcctataactgctatataacaacaaaaaaagaaaaagccatcataggtatggcactctcctatgtwcctcagaaaaatcacgtccaccctacgctttgccttcagaatcaggactgaagcatcaccattcagtcagagcttaaactaattgcaattaaagttgttttaaggagaaaaaaaaaagcctaagttaaatgaccaaacccaaatttagaaagataatgacagcaaacatcacatgaagctaattctcatttttcattaccatacaattaaagttacaatttattcctccctaagagtcaaaaaaagagttccctgcatgtactgctctagcatattctacatgtagaatcttttttctacaaattatatatttctcttcttacaatattatatatttcaagaacttaaaaagaagatgtcagcttcatattaaagaccagtcttgaataccagacaaaattatccttctcttttcccctcatttttctctttctaaccataggggcattccatagttcctttgcctctagcacacaactaagaaattctgaaagaatattgaactcaactaaaccaatttaataaacacataaaagatatttaataaatatgtaaaggtagtacactttttatctgctatttaaaattttgttttggtttggggagaggggtcaaagaggaaggaagataaactgaaagtgttatagagaggagggaaatttgaagacaccatattagaaacatgatcctatcagaatgacacagcggaattcgatatcaagcttatcgataccrtcgacctcgaag

SEQ ID NO: 1590 - DNA, 1035 bp, Homo sapiens
aattcggcacgagctatattcttcttgatttctagccttttattggctctcagattgccagagttgggactcaatagtaagtaaccattttkttgaggtggtagtgattctaccagggtgagtwatcatgacagcagaatcactgcgtttttytctctactctgtggcatagactctatgccatagagtgacgtgtgaaaggcttgaggctccctacctacgagacaccctggtccattctagcagtatggcacgtgctgactgggttttgagtctcttgctgtataatcacattactgcacttccctgcattttctcatccaaaaatggggattacctgctttgtggatcggtttgcagatgaaataacacacgcagggtatctagcacggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccgggtgtggtggctcacgcgtttaatcccagcactttgggaggctgaggcgggcagatcacctgaggtcaggagctcgagaccagcctggccaacatggtgaaaaatacaaaaattatccaggcatggtggcccacgcctgtggtcccagctactcgggaggctgagacaggagaatctcttgaacccgggtgagccgagatcgcgccactgcactccactctggtcgacagagctagattccatctcaaaaaaaaaaaaaaaaaaaaaaactcgag

SEQ ID NO: 1591 - DNA, 458 bp, Homo sapiens
ggcacgagcacctgtagatccagctactcaagaagctgagttgggattgcttgagatcgagaggtcgaggctgcagagagctatgatggtgtactgcgctccagcctgggtgacagtgagatcatctcttgctctcaaaaaaagaaaatttactactaatatttttgtggttctaaattttccaaaaactagaattatagtctacattctgcttgtaatttgcatcttttaaatttagaaatataagatgaatttcacttttattatattttctttgcatccacttcattatttaaaatttatcattgcttaaaacaattacatcagtagtaatgtttattataaaaatttgattcacctctttatgtggcaagtttctgaaatcacatatggggcaagagtatcgtgtccctctttggaaaatgccatctgccatagcttccttgagtgcagggatt

SEQ ID NO: 1592 - DNA, 1610 bp, Homo sapiens
tgcaggaattcggcacgaggcaagatctctgtctgttaatctgcctcatgaaaatgacgaaccaggagaatctatgggacagtaggaaaagctgccagtcactcagatgataataacatttaccttatacatttataatggaaatcctgccactgtttacaccagaaacagtttctttttttttttttaattttattattattatacttaaagttttagggtacatgtgcacaacgtgcaggtttgttacatacgtatacatgtgccatgttggtgtgctgcacccattaagtcatcatttatcattaggtatatctcctaatgctatccctcccccctccccccgccccacaacagtccccgatgtgtgatgttcccccgcttcctgtgtccatgtgttctcattgttcaattcccacctatgagtgagaacatgcggtgttttgttttttgtccttgtgatagtttgctgagaatgatggtttccagtttcatccatgtccctataaaggacatgaactcatcattttttatggctgcatagtattccatggtgtatatgtgccacattttcttaatccagtctacaccagaaacagtttctattgagaaaatggattttaatagaaaattctcatttaaaatttgggcagatatctgtattgttgagttaaccaaatgagaagagaaaaatccttacaacgtagcttgtcatttgcctgacttgatgcagactgctttgcttagtaatcatgcagcactatcaagactgtgtacataatgtcaggatccatctacataagatgtagtatggactgatgccaagtgagcctggggtggaaatcagaactggatgcaaatcctgatgttatccgagaacaggcacctgttacataggctgtgttactgtggcaaaggtaatggtaaaacacagactggccagaagcattgtgtacaatgagaccttgcaactttgtgtatattagtatgtggggggatgtgaattattaaagacatttaaaactgactgaatcagcaacctctaatctataaaaaaaaattccagacgtccagccgggcacgttctcgtgcctataatcttagtgctttgggaagctgaggcaggaggatcacttgaggccaggagtttgagaccagcttgggcaacatagtgagacccctgtctctacaataaaagtaaacaacttagctgggcataatggcatgtgcctgtagtcccagctactcaagaggtggagatgggaggatcacttgagcccaggagtttgaggctgcagtcagccgtgactgcaccaccatactccagcctgggtgacagagcgagatcttgtcttaaaacaaaacaaaacaaaacccagacttcctataattcctaaaaataaatgtgggtttgagaggcctaccttgaaatgtacaagatcctggccagacttcacctatctaacaatatgctagtaactatttgttgacatgtcttaaagaaatgttcatcagggcctcagaaagcaaggcagagaacaggtccctgaaatttactagcttgcaccaaaccatcagataaagataggttaatatttgacagaaaaaac

SEQ ID NO: 1593 - DNA, 1085 bp, Homo sapiens
  misc_feature (506)..(506): n equals a,t,g, or c
gatgggtgccccaaatgcttggtccaccatcatcgtgcctggcatgaaggatgctgtgatccacgcacttcagacctcccaggacaccgtgcaatgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggaggctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagccgaggatcaggaagtttaaggaagttgcccaaggttgcacagctcanaagggcacagctgggatgcagacccagcccgtcaccacttccccagcctccacaccaaggcccagctgccttctccccatgtactccgacaccaagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaaaaaaaaaaaaaaaaaa

SEQ ID NO: 1594 - DNA, 910 bp, Homo sapiens
ggcacgagagcatgtgtgtcaaggaccttgctgggtcaacaattcatttgcctttgtctggagtctgccagcagcagtagctaatgtctaaaagacaacaggggccaggagagaaaagggaggaaagaactaagtctctcctagtctatggcatgctatcatggggtcaagtaggggcagggaggcttcatggggcctacctttgggatgacattaccccagtgggcattgtttgggtggttttcttttaaactatttacactgatatgacagactcaaactcatatttgctattctccgagcacatggaaaggtaactcactctgtacattcagatatcaaactatgcactgtgagggctacgagaagcgcaaacagtaaacgcttggcaggagggaacacttcctctctctgaggaagaggctggaagctggtcttccccctccaagaatacacgggtgcactgagtctttatgcaaaggcaacactgagccatggccaagggcatctctgcggggaccctgggaaaggagcctgcttccaggtgttccccaaagagatggaaaacaagacagtcatttggaacagtgatgcataataaaatgtatgtggccaccttacaatactgctaagttgctaaaatatataaagttaatatttgagttctatttttataaaatagttctagatttatggcaatataaacgtgtatagccttttgattttaatttctagttttgtgctttgaagaaatatatgtaagattaaagaactgtatattgtaagcattatattcaaattatttaaaaattgttctaagtctatattcaataaaaagtaatgccaagaaaaaaaaaaaaaaaaaaaaaaaaaaaaaaaaaaaaaaaaaaaaaaaaaaaaaaaaaaaaaa

SEQ ID NO: 1595 - DNA, 1654 bp, Homo sapiens
  misc_feature (450)..(450): n equals a,t,g, or c
cccccgggctgcaggaattcggcacgagcctctttgaagtttctagatgcaccacttcctgctcacagcctggaattcggttaacaagtcagtgtcaacctacctttcccttcatgatttatagacttttgggagtaccttctggtagcttttgtcttcccataggaaagaggcccaatcccagtttgtcctcacaaagcggccagctccgtgatatctcttttgcgggcagagttaagattgtacacagatccccacaagtaccacgatttttgcctcaggaaggataaagcacatgtttgtttctgctttcgttttcttttttctttttttcacgaagccttatggagaagtatgtttctgctttctttcctgaggaagcctagcttctgggccacgggactgatcctgtctacatcctctttccctccattctccatcgtgtctctncccccgtctcaccccaccccgtgcccctctctgcctcagcttcccctcttcccctgcagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttaaaaaaaaaaaaaaaaaaaaaaaaaaaaactcgagggggggcccggtacccaattcgccctatagtgagtcgt

SEQ ID NO: 1596 - DNA, 1193 bp, Homo sapiens
aacaggtctttcctgttttctggacctgctagaaagcttcagtcagtttggtccctgggagagaaaacgctcttcccatgacggctctgtggaggccaggaatggggtaggtgggttgactgggagtactccttcctgccgccctggtcaagggactagtgtgagtcgggagtgcatttttggaatgggggcaggggtgtttttcatgaccatttatttgagtggttttgatggttatgcatactctttaaatttgaatccaaattttttgcaaaattacttcccaatcagatcttgacccttagcctgggacaccacaaactgaggtgaattcyckgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacaaaaaaaaaaaaaaaaaaaaaaaaaaaaaaaaaaaaaa

SEQ ID NO: 1597 - DNA, 983 bp, Homo sapiens
ggcagagaaggaccccaagttaaatctcccaagttaaggctgagagctccagctctcttccgaaaagctggagctgccaacccttcccttgggacctgccgattatgcagttttcttctgatactagctttggtttctgaggtattctgccctctccctcccctcttctcccaaaacatctgcctctcctcagtccccgtctgggtggtgggtgcacaataccaagtgcctgaaaagcctgagagagagggtctggggtagggtggggaccactggacaccccaagtgcaaactgctgctttctgacccttgcttgcttatgtactcccttttcaactgtgttgaattttaatgacgtttttagtggtgtagaaatgcaagtattttggcttaacagcatgaagtctgggttgcacattgtatcagaggtgctgtaatctttccagtatctctgatatacggctttctggttgaatgtcaccctgggccctcttgactggataaacaaccatgagggctcttctctgtggagctgccgagagcttggtggtagaaagcgatgtttctaaacaactgcagcggctctttcctgtctgaactgcatcgtgtgtctgactgccttgctgtccatacatacagactccttcccaggcccggctctgtgcagaacttccatgttttaccacatttttctctcctgaactccctttgtcagccccagggtgttgaggctgggtcctctctagcaatctctaccttcagaagagacttttctaaatattttgcttttccagttcttgttgcttttgtcattgtgaagagtcacccaggatgctggcgcttggtaccctaagatcagaagtggtgtgtgtgtgagctgtgagacatgcacaccctttcagagtgatactgtgtggtggaaggactgttagaactcaaagaatagttaataaatccagtgtattaaaaaaaaaaaaaaaaaa

SEQ ID NO: 1598 - DNA, 847 bp, Homo sapiens
ggccgagcgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgcccattagatacaactacatcttgcgggggttgtttctttcttgttccacaatgaaattgcacatccatctccaccccagctgatagcctgttaataagcactggtctaacacagccaaccctccttccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatcccacaacctttggttgctgcattccccttggttcgattccacgcaaggagccacaagtgagaactccactgtccttagaagaaagggcatttttacttttgaaccaaaaaaaaaaaaaaaaaa

SEQ ID NO: 1599 - DNA, 282 bp, Homo sapiens
ggcacgagacagaatgctgttgccaaaacctgcacagccctgaggccagcctcggccttggtaacgggggaaagtagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttgaaaaaaaaaaaaaaaaa

SEQ ID NO: 1600 - DNA, 2707 bp, Homo sapiens
  misc_feature (938)..(938): n equals a,t,g, or c
gaattcggcacgagcggcacgagctccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctggagtcccacatggntatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctrttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccgtgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatamaaaaaaaaaaaaaaaaaaat

SEQ ID NO: 1601 - DNA, 429 bp, Homo sapiens
ggcacgagcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaaaaaaaaaaaaaaaaaa

SEQ ID NO: 1602 - DNA, 1721 bp, Homo sapiens
ggaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttgcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtaaaaaaaaaaaaaaaaaaaaaaaaaaaaaaaaaaaaaaaaaaaaaa

SEQ ID NO: 1603 - DNA, 1287 bp, Homo sapiens
cgtgccgaattcggcacgagctaaagatttttagactgactgtgggttcactggaataaaaaggaagaaacaaagagcattgcaggcatcgggactgtcacatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggtttaacatttgcctctacctctgattttgctttgctgtcaaagtttaacaccttccaactacttatgtgtgtcctgtaacacaggtgattgaccgtatgagaggggaaaggcaaagaaaaaggaagccagacactaggggaattattaacttctcatacttccccacattgagaagcattcggagtgtatttagccctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggcattatttgcctgttaaacagtgtctttcatgttctctccccagattgtaaactctgtaagaagctgcttgtatctgtatcccttgttgaaactctgaaaacactgaataactaaaatctcttctcatccttttaaaaaaaaaaaaaaaaaaaaaaaaaaaaaaaaaaaaaaaaaaaaactc

SEQ ID NO: 1604 - DNA, 1290 bp, Homo sapiens
  misc_feature (1279)..(1279): n equals a,t,g, or c
  misc_feature (1284)..(1284): n equals a,t,g, or c
  misc_feature (1286)..(1286): n equals a,t,g, or c
ccaccgcggtggcggccgctctagaactagtggatcccccgggctgtttgaattcggcacgaggcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctgaaaaaaaaaaaaaaaaaaaaaaactcgagggggggcccggtaacccaattngcccnanaagg

SEQ ID NO: 1605 - DNA, 1037 bp, Homo sapiens
aattcggcacgagaacaaactaaggcagaaatactaaaaatatctggttcaataacataggggcatggagtagacatgcagaaaatgcttgttcacttgccttgaaatggctccaggtggcctgaaggaatcaatgaaacttctcaagtatctacattacaaccactggtccccactacacatttatttctaaataaaggaggagaaactctagcaaagtaatatttaacattttcattgcttccaggataaatcttattgaatatggaggatctgatagtggtaggtctatcaggaatatcagggaaaatgcttttgatgttgttggcaaagtcaattcctatcatttgtacttgacaccagctacctagcaggctcattgtgaacttcaggtttcgcccacgttatttatataaagtatctcagtgtaatatagggagttgctggttatttgaaaatagtaacaaagataacccaaacgagaaactccatttccataattagctttcctgaaagtcaggcatgtctttgaggacaggttttggcagtattatttttgtgcacaggaggaaaattgttagtaggtttatagatgttatttttataatagaatgttaaacccctgaaaaacatcaaaaattgtctcctagaactaattctatgttttaaaaacttgttttaaaaaggattctaaatagcaatagggtctttcctcctttctccactccaatggtttaatgggatagaggaatcaatgtttatatttttaaacctgtaaatattttattttgggtattttgtatatttgttgatataattccattttgtgcatatgtaccattgtgcatgttgctgtttttgatagtcactcttttaatgaatgtaagaagcttgggctaatagcacttttcttgttccattcaaacatctgaaaatgaaattacaacactgccattttactgttgtgtttaattcagtcaataaattttgttgctcctttccatttaaaaaaaaaaaaaaaaaaaaaaaaaaaaaaa

SEQ ID NO: 1606 - DNA, 946 bp, Homo sapiens
ggagcttttaagtttggcctctcacactctcccacacctgctaaatccttataaatgtttcttctcttccctcaaacttccctcactgtcttatttgtttcttgccctgtggaaggcagtagggtacacattcttcttagtgtaaatatgccttggaatttgcacaagggcaggacaatgtgttcttttttccaacagctgttttgatgatgcttggcaacatgttggtatttttggcccgagtagcacatattgagaccacatcctcaaggaatactttttgatctctcccaagtctcttttctagactgaatggtttggattttccattgatgaaaaacattccccttttcttgcccacatgagagtttatctgcccgtttttctgatcatctctctcctcttgtttacagcacatgcaaaagtctcttgggctcttcctatagtttataacttttgttttagttttatattacctggaatagcttaggatcatctcagagggactctggcatagtccctcttggagatcagggatgccaggaggggcattaaggatggagagatcaggtgaatagtgaaggagtgatactggacaaattgtaaagctctaaagctccaccaggtggaggagggcacaggtgctgaaagacaagagaggtaagggaaagcctagaatcaagtcagaggcacagcaaacaaaagtaccccaagcaagccagttagaccaagagagaggctcattgtcctgtcttttctttcttatgggtgcgtggccctgaagcaggagattctgmtcttgaatgggaaagggttttcaagagactctttgaccagttctccatccatgagaatacatctcaattaccatggagacttccatcttaaaaatagccattgagtggaatcttagtgcaaaaaaaaaaaaaaaaaaaaaaaactcgag

SEQ ID NO: 1607 - DNA, 1636 bp, Homo sapiens
aattcggcacgaggtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggccccgctccccgggtccctcctagacgtctctgtcccaaggagtcgcgtgcacctctcgagaagctcctcacagcgtcgctcccggccctcttttcgtcggactccagcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacgtaccccactgagaccacctctcagggtgcctgccctggttcctccccagcctgagtcagctgtctggactgcaaggaggctgggcacggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaaaaaaaaaaaaaaaaactcgagggggggcc

SEQ ID NO: 1608 - DNA, 409 bp, Homo sapiens
  misc_feature (388)..(388): n equals a,t,g, or c
  misc_feature (401)..(401): n equals a,t,g, or c
gacaattaagcagcatatcaaggttcatgtaagttacagttattaggtttaatatttagttttaatatttttcacccaacatcttgttgcatcttccagaataaatctggggtccataaaccaaaccaggagagggaaaatggaaagagtgggcagaaatctgacagctcttaggtttcttctatttgtgttaatactgagacttttaaaaatcatttttatatgtagtgtttattatgaatagttgtaatttgttctgataaattagttgtattaaacactgttatttggctaatattactaggtataataaaatgatatttagtgggaagacattcatcaaagtagaagtagttaatttgggccaggtgcatggctcacgcctgtnaatcccagccacnttgggagg

SEQ ID NO: 1609 - DNA, 1652 bp, Homo sapiens
aagcttggcacgaaggccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcaaggaattctgacagaaacacaacaagggttaatggtagccagccctgctcagaccctcaatgacacgctggatgacatcatggcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaaaaaaaaaaaaaa

SEQ ID NO: 1610 - DNA, 1528 bp, Homo sapiens
tttttgaagattgctttgtattttatttacaacagaatgtaagaaaaagtaagttattaacaataataaataactaggaagaaaaacacagaacagccacaaaatgacacagaaggatggcatatgtaaggatcaacttttgtttgctttgcttatagtctgtaatgctgtgtattccaacacctggtccttcagcagtggcagtggtatgtggattaatttaaccaatcaagatcccagcttgaatgtaaacactacaaattacacttgagctacatgtgagtggtacaggtacaacaccaactcagagaccctctcctgggtgatatatagaaactgaagggagacttgcaatttgacagacatgctttcaatttaaagcaaaaaacatcaagaggcttatcctaaagtccttgttaatttaacaacaaaattacaattattaatggcatctgaaaatttcccaacatattcacattctcttattacactaactcctaaaaagcttaaacacttatatttcaaatgcaaacagattgttttgaaggtagaacacaaaagaacccaatgttttgcctcagcatgccaacagtgtgctattgtgtacacttcagtttcagcaagaatgaatagttaaaatagtttattcataatcagattgcagtcactggacagactttttaaatctcaagaactatggctcagatgacagattgtctcctagcctactgagtcagatgatcagaaaggtactaaaactatttggacaattcctctctattggattatctgattacacattatatgtagagtcagctatacactggcccttcttaagagtaaaattcctatcgacgtaagccagccaatgacctattactttgttgtcgctgagccatgaagagatgccaaagaaagtagaatttaaaaatacacataaatacattagccctgaaacttttgcagagaatgatttatcgagatgtatcagaatctattctcttagttcactgtttattacagtgtcttgaaagaaaaccacagttacttttgcaggtattgtggtaagtgtctgcataatatacccacaactgtgctacttagagatttattttcaggaccaacaacatggctaataaatacttccaaataaattaaaattttcctcacacacagatgcaaaaccgtaacagaagccttgataaatcagttcaccaacaaacccatattgtttgagttacaacggtggcaactaaaaatgtcacggcctccttcattgtgttccttttcctttgctttgtcttgcaacaacccaaagtgagaaaatgaaatgatcttcagaggtgatttctaacaaagcttatgtgttaaatacaccaagatcttctcatcccaggaaagcacagctaaagcaagaatgccgtgctatggccaagaaaatgcacaggggcacttcacatttgaaatcttcccagagttatgaaatgtacagtcattttgatggtctccactaacttcagacctcgtc

SEQ ID NO: 1611 - DNA, 1790 bp, Homo sapiens
taacaagcttggcacgaggttagggaagcagggtctggcttttaatatgaactgcaaaaagcagcttctcactgatatttttttgttgttgtttctggggggtttttttttttttttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggagttttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtaaagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattatctttaaacgactgcctttttcactctttatgtaaccttctattgtgtggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaaaatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtaaaaaaaaaaaaaaaaaaaaaa

SEQ ID NO: 1612 - DNA, 2324 bp, Homo sapiens
  misc_feature (41)..(41): n equals a,t,g, or c
tcccctggcagcccaagggtgttgggtccgcgaagctggantggccctctggtggagcctgcatccttgcctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgacaaaaaaaaaaaaaaaaaaaaaaa

SEQ ID NO: 1613 - DNA, 2913 bp, Homo sapiens
  misc_feature (2288)..(2288): n equals a,t,g, or c
  misc_feature (2753)..(2753): n equals a,t,g, or c
acaaaagctggagctccaccgcggtggcggccgctctagaactagtggatcccccgggctgcaggaattcggcacgagatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtgrctggsaaaacycctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattgggataaatgaaggagagtagttttattctgaaggtaattaaatttagactatgtagtatgtgacagaatttttttaaaattatwaaaagrttttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccnggttaattttwatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgngctaaagccataggaagaaaaatgtgatgtgtccagtatgtactattttgtttttgttttgcaagaagagttgaactatttttgataacaagagtaaatggtggaaaatgcttaaaaaaaaaaaaaaaaactcgagggggggcccgtacccaatcgccct

SEQ ID NO: 1614 - DNA, 424 bp, Homo sapiens
  misc_feature (409)..(409): n equals a,t,g, or c
  misc_feature (416)..(417): n equals a,t,g, or c
  misc_feature (421)..(421): n equals a,t,g, or c
ccggttggtctcgaactcctgacctcaagtgatccacctgcctcggcctcccaaaatgctgggattacaggcatgagccactgcgtctggtccttggctgtttcttagscccactcctggcagtgtctcttctcttcagctatgactggggagtagatgaccgtgcttgtttctgacacacagcacagtgtcctctctgtacacaagctggtggttcaagggccaatggttccagagagatagtggttcccttccttccctcctcaccaataggcagcctcaggccttttctgtgtataactgtgtatatagacataaaaacctacaaatgtgaaataaatctatgctatctttcatagtgttaccacaaaaaaaaaaaaaaaaaaaaaaaaaaaaaaaaaaaaaaaanggggggnncccntta

SEQ ID NO: 1615 - DNA, 1844 bp, Homo sapiens
  misc_feature (1699)..(1699): n equals a,t,g, or c
aggaagtgccgatcggctgctggggcgaaaagggggcgccgggccgctctagccgccctggtccagcgcctccctctctcagcatggacgaggagagcctggagtcggccttgcagacctaccgtgcgcatgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctgkacgaagagcgcccgggccgccargaagatgctgagtaccaggctttccgggaggccatcactgaggcggtggaggcaccagcagcggcccgtgggtccggatcagagaccgttcctaaagcagargcggggccagaatctgcggcargtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttssaggacccagacctgagctccctgcaggccggctctgcgtgtctggccaagcaccaggatggcctctggmacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcgggaaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggncgcctgctggcctggggcgtgcggacactgctgagtggagacagagctgcggggtcccatctggacacttacttgcccacctgccagtgtcttgggcatttccttggcaaggacattaaagtgatttcatcacagaaaaaaaaaa

SEQ ID NO: 1616 - DNA, 2124 bp, Homo sapiens
  misc_feature (8)..(8): n equals a,t,g, or c
  misc_feature (76)..(76): n equals a,t,g, or c
ggcggttnaaagggcaatcagctgttgcccgtctcactggtraaaagaaaaaccaccctggcgcccaatacgcaanccgcctctcgccgcgcgttgccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctaatacgactcactatagggaaagctggtacgcctgcaggtaccggtccggaattcccgggtcgacccacgcgtccgagttaatagacacttgaattgttttcggtttttggcaattaggaataaagccactgttaacattcacatataagtctttgtgtgggtgtgtattttcttacttcttctgtgaatactcataaatgggactgctcagttatatgataaatatatgtttaactttgtaagaaactgctgaattattttmcaaagtggttgtaccatcccgcattcccatcagcaatgtttggaaattccagttgctccacatacttgttatgggtcagtctttttaatttcggccattctagtgagtgtataatgatttcttgctatggttttaaatttgcgttttcctaaagactaatgatgttgagtattttataatagttattggaccaaagggagttcttcatctttgtaacattgatataataagattatttaattgctagttgatactcaggttttgtcacttgtcccaataatgtccataacaagcttttccttcctctagatmcaaactatgaccacacattgggtttagttgtcatgtttctttggtttcttttaatctcagttttctttgtctttcttagacctcaacttaaaaaaaaataataaaaaagcataggcctattattttgtaacatgtctgtcaatttgggtttatctgatatttccttatgataagattcaggttggtatttttggcaagaatgttacagaaattatcttataaccttttcaagggcattgtatcaaggacccccgtatgtgactattagtgatgactttgtatgttgcccaagaaatttatgcctattctaatgttgctaataattttcctgttttcttctagaattttcatagtttcggcttttaagtttatgaactatttagaaatattttgtgtgtgtgatgtgaaatagggattgaggttcattcattttttttttcaactttttgccttattagcttttcctatttctttgayttctgcttattattattctactttctttgaaatttaatttgctcttctttttctacctttttaagttgaaaacttaggtcaatgttttatgacctttcttttttttaatataagtatttaaagctatgtatttcctgctaagtactagtatactgcatcccatgaattttgatatgtaatttttattatcacttagttcaaaatatttcctaattccctttgtaatttttttgacccttgggttattgagaactgtatttaggaatacttggggcttttatagatattttactgctagtggttttttgtttaagtgtgtgtctktgtgtatgtgtgtgtgtatgtgtgtatcagcaactataaagatctcagtattttgaaatgtattgaaacttattttatggttagtctattctcacactgctataaagaactgcctgarcgtgggtaaatttacaaagaaaagaggtttaattgactcaaggkktaattgactcaaggttctgcatggctggggaggccttaggaaacttacaatgatggcagaaggggaagcaggcatgtcttacacagcagcaggcaagagagtatgtgagagcacaggaaaaactaccgtttataaaaccttcagatctggtgagaattcactcactatcacgagaaggcttagaagaaaaccccacaaaccccattactaaacccacactcaacagaaacaaagcatacaaaaaaaaaaaaaaaaaaaaaaaaaaaaaaaaaaaaaaaaaaaaaaaa

SEQ ID NO: 1617 - DNA, 2312 bp, Homo sapiens
  misc_feature (239)..(239): n equals a,t,g, or c
ggcggactgacaggcccgggcaagggtcgcttcctcgtccgcatctgtttccagggagacgagggcgcctgccgaacccgggacttcgtggtaggagcgcttatcctgcgctcatcggcatggacccgagcgacatctacgcggtcatccagatcccgggcagccgcgaattcgacgtgagcttccgctcagcgagaagctggccctgttcctacgcgtctacgaggagaagcgggasnaggaggactgctgggagaactttgtggtgctggggcggacaagtccagcttgaagacgctcttcatcctcttccggaacgagacggtggacgtggaggacattgtgacttggctcaagcgccrctgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcactgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttatccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaaaaaaaaaaaaaaaaaaaaaaaaaaaaaaaaaaaggggggggggc

SEQ ID NO: 1618 - DNA, 1058 bp, Homo sapiens
gactttttttcatctgcttattttcagcctatgtgtgtctttataagtgaaatgtgtttcttgtagacaacagataattgggtcttgtttttttatccattcagagccactctgtgtcttttgatttgagagtttagtgcgtttccattgttattaagaagtaaggatatgttctgccattgtattgtttgtcttttgcttgttttgtggtcttctcttcctttcttcattccttcatttcttttattgaaggtgattttgtcttgtggtatgatttaatttcttcctttttattttttaggtatatgtyatatggtttttgatttgaggttatgatgagtcttgcaaatattatcttacaacctattattttaagctgataaccacttaacattgcataggcaaaaacacacagaggcaaaaagaaaaccaataaaagctctacactttagcctcttgctttttaactttttgttgtctctgtttatatctcattataatttctatgtcttgaaaagttgtcattattagttttggttggttcatcttttagtctttctccttaagatcagagtattttatatatcacatttacagtgttataatatgctgcatttttttgtgtacttactattaccagtgagttttggaccttcagttgatttcttattactcatcaacttccttttctttctgattgaaaaactcccaggctggacacggtggcccatgcctgtaatcccagcactytgggaggctgaggtgggctgatcccttgaggtcaggagttcgagaccatcctggaaaatgtggcaaagctccatctgtwctaaaaatataaaaaattagttgggtgttgtggcgagcacctgtaatcccagctacctgtgaggctgaggcaggagatcgcttgaacccgggagacgaaggttgcagtgagccgagatcgcaccgctgtactccagtcctgggtgacagagcgagacgccatctcaaaaaaaaaaaaaaaaaaaaaaaaaaaaaaaaaaaaaaaaaaaaaaaaaaaaaaaagggcggcc

SEQ ID NO: 1619 - DNA, 2732 bp, Homo sapiens
  misc_feature (334)..(334): n equals a,t,g, or c
  misc_feature (1885)..(1885): n equals a,t,g, or c
aggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcrcacagatcccgctgcacagagccagttggaatccctancctcctccttcaaacccttccagcttccactccccacccccaggctttcaracggccttcagaccccccagcaaaacccccacagatttactacagagttcaacactggaccgccattaggcawagaggagcaaccattakaaaatgcaggatttgtcccactctkttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacacttgggttgtccttgtttttgtttttctgttttgttggatgtgagtttgaaaggttttgtgacaagtagccatcagatgtttccatttgattttacatcttcaacagtggggagggaggatggtttagaagaagaaagtggrggagaaacaaccattttattgacagycaatggcatccttgacgttcagcccatcttgtcctcaagaatccctcttccagtgcctttcagtagaagattcctctttctgctattgtattatgcatgccaagccttcyyaactgagaagccytatgygccagtaatggagaggttattgacatgttgagatgttggttctntttagggagacctggcaggagcagcagtcactatgtcacacaagtgacatctctttgtgagtgccatgatgggaaagagatcgggaaacactgatgtagatgatccacagacacatcttttatgactgaccattttaggaagtacctgatgatggggcaacgatcgcaccactgaccaaaagagggtagaggatgaaagttacctgttccccaacagagcaccaggatctgtgtggtttgtatgtcttgccttgggctgcattcagaagcccaaagctggaactggcatattttcagccatgtccattaagggatgtgatgtaggatcaactaaatagatctagatcgtacgttctgtgctttcaggtgggtttttttcgtccttacctttatgctgtactttaatttgttaaaatttcaacacaatttttagaaacttaaacatgatattctcaaataaatgtcaccagaaatagatggtgatcaagtggatagtaaattgttttgtaaaactwacaaaatttccctggataagaggagaggactagaaatgacaggctctctttgcccttgaacttcacttcagtctcctgaaccttcacattgtactgcaaagtgatggaccaatgcacaaataatattcagatggcagtgaattgtaatcaaggctttttgcggggatgcggggaagtcctgakatggggcatatcaataaaaatgttgctttttttgtaaaaggagggaactcctaccttataaggctgtgctgtaattgtgtgtgtgtttaatcagtcatacagaagagtttataaaaagcatgactttataaaaagtatgaagaataaaa

SEQ ID NO: 1620 - DNA, 372 bp, Homo sapiens
ccacgcgtccggtgaacacagagaaatgaatttattccccatatgggtatgtttgccccctggcaatgcatttccatactctttaacttggggactgaaatgttataaattgacagttctactcagaagacctttcaagcatcttgtgtttatgagaatacaggggcatctgcggaatgaattcgaacacatggatgaattaaatttgaaaacacacagaccgagaggcagacagttcctaggctgtggtcgttgcatggattttacaaaactgttaacctacacctttggctttgctgtgttcattgtcctggggaagaattgtgggtttaagaattactctttgattaaactacttaaaaaaaaaaaaaa

SEQ ID NO: 1621 - DNA, 2043 bp, Homo sapiens
  misc_feature (308)..(308): n equals a,t,g, or c
  misc_feature (1672)..(1672): n equals a,t,g, or c
gtgcatctacagggtatgtgtttaaatgaggggtagttgacccacataactccccaccctcctgcctcatggttagaatgtatgttcattggggattctgcatacattttcatcacatatctacttttctggcttttaagtaatatcctctcctttgtttttgccaacagtgttcatgaatagtgaatgtaggaaagcattatcattgctatgttttattttcacactgtatctcagtatcagcccatactttcaatgtactaacaactgtcactgaggcaaaaagttttaattaagctcacacatgnattattttccagcaaacagagcctaattgatgaaattgctaactgtacttccaggtgcagtcagtagccagtagtgcatgttagtatgcaatatggcatgggctgttacatggtgtgatactagattatatatttactatgaacgtatgtattgttctttaatgacatctawttgktcattccaaaaatatttattgagcacggactctgtgccagttattagttagagtaataatagctgctgtggcaaatgaatttcctcacctaagaaaaataaaagttaattattttttctccacataaaggtctagaatgttctgccgcatgccttccatgtcatgattcagggacccaggctccttccatcttgtggctgccccatccactaagttctcagactctttcatttccaactggtggttgttgaaagagaaggtgatgaaggtgtaccccacttacatcttacccactttcacctaraagtggcacatatcacttttattgacgtttcattagcaagaattgtcctgcaacacacttggaggaaggcagctgggaaatgctgtccctggctgtgcacagggacatatgtattttatgtattttatgagactctttgcaggatagctggctatctctgccacagctggccatgtctgccatggctagacatcatttcaggctctagggaaatagcagtgaagagaaacagacaaaaatatctgacctcatggagcataaattcttgaattaaaattcttaaattcttcatgggatgagacagacaataaccaggctaaatcagtatgttgcaaagcagtgagagctgctaaaactaagcagaaaaaggggtacaaagcatgagagagaaggatttgagatgagatagtgtggtcatagaaarmcacactttcwatcagcatgagagaaaagctaaagcaggaaaaggggtagaaagcatgagagaaaggtttgagatgagttagtgtgctcatagaaagcgtcttgaaagaaatgatattttaagtaaagaatcagagagcataaggtgtccaactaggtgaatatctaaagcaaaaacattccagatggagagaatagcaggtaaaaggactctgaagctggtgaagataataagggtgagaataatagaaggtgagatcggagaggcaatcgtcaggccagactgtgtcgggccatttaggtcatagtaaaaatctgggcttttttttttgtttttttttttgtttttgtaactaactttattgaactatgattttcataaaatatacccattcggtaggttttaaaaatgtagactgaagacattcatataatcaccactacaataaaaatatagaacntttttatcatcccctaaagtatccctatttatagttcatacctggccccagcaatcactgatatgccatcacagattagtttgttttttctaggatttcatacaaatggaaaggaacagtatgtactcttctgtgtctgtattctgtcactcaacataatgcttttgagattcattcatattgttgtcagtatcactactttatttctatttactgccattatatgaattctattatgtggatataccataatttatttaatctttcacctactgagaggcatttgagttgttgataatttggggctgctatgaataaatctgctatgaacataaaaaaaaaaaaaaaaaaaaaaaaaaaaaagggcggcc

SEQ ID NO: 1622 - DNA, 1557 bp, Homo sapiens
  misc_feature (1557)..(1557): n equals a,t,g, or c
atcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcaggrtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaagcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttamcttgggtccatgaccgtttgcattcgaaacacaatacactgcctcgttctctcagttagcagctgggcagcagcgcaccattcatcatttaggcttgtggtttgttgtttactctaccaatgttatgtygaaactgcattgtaaaaagagaagaaaatggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacamwaaaaaaaaaaaaaaaaaaaaaaaaaaaaaaaaaaaatn

SEQ ID NO: 1623 - DNA, 1699 bp, Homo sapiens
  misc_feature (2)..(2): n equals a,t,g, or c
  misc_feature (26)..(26): n equals a,t,g, or c
  misc_feature (28)..(28): n equals a,t,g, or c
  misc_feature (56)..(56): n equals a,t,g, or c
  misc_feature (62)..(62): n equals a,t,g, or c
  misc_feature (1239)..(1239): n equals a,t,g, or c
gnaccggataccattttcacacaggnancagctatgaccatgattacgccaagctntaatanggactcactataggaaagctggtacgcctgcaggtaccggtccggaattcccgggtcggacccacgcgtccggcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcrctgattgtrmggnagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaaaaaaaaaa

SEQ ID NO: 1624 - DNA, 1796 bp, Homo sapiens
ggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataagggcatgtctgaatctatttaatctctttgcacctgtttgggcaattgatgttttaaatatttaaataactaaactctctctacagtacatactcacttttgatttatgaattggcaaaattcaacttttttccttgaatattcttaaactgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgtatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaaaaaaaaaaa

SEQ ID NO: 1625 - DNA, 1535 bp, Homo sapiens
ggcacgagctggggtaagtttcccttgttcctcaagtaagacaggatatactttgcaataatctaaaaaatctagatgtgacctggacaaagagagagagacaaagtataaaatgctttcttagggataactcatactcttggtgacaagaaatgttaatggtgtcctgaaaccttttggtcagtgattgctccattatgtgggaaaaacataggaaaataaacataggaaaaacaaaggaaaataaaagactcatagtacttcaataaaagttgtcaccaaatcccaagaaaatgattgcattggaaggaatattctttttgttttaattgatagtattttaggaagtagctaacacttgttcttatttcctagcttaaaaagtgaatatatgcacacacatatataactagaaagtgatatattaacattttctattaacaagttttttatctcataaaagatattctttggctttcgaagagaagccaaaataaatatcacataggcatttcagatatcccttcctttaaatgtttatagtgatacataaaatagaaattgcaaatatttgatattttaatattatttttgctttacaatagcatttttagtgctccatttttaatttattttatctctccaggttaataatctatcataatgtccaaattacacagtattgtattggtcagctttaagtgcccagatcaatgacactgaacctggcaaatgcaatgcacatgcacaacgcctagcttctaacatcatggctgttgaaactgtctcctctccaaagcattttcccagccccatctctgccatttgggtctcatctgataaggtttaaccatgagttgttatactccatgcatggcctctggcatttgtgtgtattgtgattctaaacgtcaaatggtaaaggataacattagattatttcgcttttattttgacagagttcaaatagcaaaataaattagatatactgtcacagcttaagaaatttaaaatgaaatatgttgtagtcaggtggaagtttctgccggggaaatattaacacctaatttcccagaatacttatttcatgcattgcaaatatctatctcctgtcatgacactgagatgaaaaggatcggttaaaagtttgctaactgaactatttcccacagtgtaaataactaagtgttggtatagactagtatggaaacatactaattacactgggtgtaagctatgtgagttgccttatcttttcacataacatttatatgtattgcatttcccatatcgtttccttttgttttgctgataacaactaatgaggaaaagaaaggaagcattaaaaaaaaagaaaaaaaaagtcttccaacaaaactgctagagagagaaagccaactattataaaatataagcacaattctattgaaatatcagctccagattcaagtaattttgggcatgtgtattatgtgccaggagatttcacttacatatgttatggaacgcagtgatttaaaaaacaaaacaaaaaa

SEQ ID NO: 1626 - DNA, 1328 bp, Homo sapiens
gctgcaggaattcggcacgaggtgacccaggcacatggtgcaaacctaggacctccacctcccagctctgtagccaggggcagctcactccaccctggtccctggagtgtgcttacaggcttccgtgttggggggctgcgaggcctgggcagcaaaccgccttgtactgcctctggcctgtggatagtagatgctcaataaacctctccttcctgtcagaaactcagtctccctatgtggatgacagcattttcctaaaggatctaaagttccatccaccttaaactctgcctgaagggaagactatgaaactagaaaagaaaatggtgtggatttgtgtgctactgcagacactgctgcgacatatattaaggagcatggaacggaaccgcgtggatgataaagtctgcgtggtgtttacaaaggaatattcataagcactttctgagaagccccgtgcagctgctaacagtgactgcctaggggaaaatggacttgaaggagtagaggccaacttttcattttatacctttctatactttttaggactaccacctatgtacgtgcattttatttttgttaaatgttcgcaggggatatctggcaggacaaggaactggctggaaaggggcgcgaggagatcttctgggtgacggagatccaggtggtggttactcagatgtattttatccttcaatgagaagtttatttcgaaaacgtcctgtgtctcttccaaagatagctccagctgggcaaagtggcagctctgtgggctccaacggaagaggccaaaaggcccatcctcctcctgtcccctgggttcaattcacagccctgcctgtctctagctgtgtgatcctggacgtgcctctctgcttcctcagctcctgcttcaagacaggcctaaccaaattttgagaagtccccagcagagctcccgaccctaatcagagaagaagaatgaatgttctgagtgggtaccacatggcaggtgctattctaaatactgaacagctgtgaacccatttaatccccgtaagaaactggtgagcttggtttcatttgactcaagaggcccagagacgaaagcaactggtccagggtcacacagccagcaggaagtggatcagggttggaacctgggcagtctggccctgaagcgctgcagaaagtattattttgggagcaaataggtaataggtggtgagagccacctaaaaatacccctcctctctggcccagtaaccacttctagaaatctgccctaaacaagtaactcaaataaagcgaaagctgagataaaaaaaaaaaaaaaaaaaaaactcgag

SEQ ID NO: 1627 - DNA, 1232 bp, Homo sapiens
  misc_feature (22)..(22): n equals a,t,g, or c
  misc_feature (1227)..(1227): n equals a,t,g, or c
ggaaggttaagaaatggaattnggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttctsgkgccgaattctggaancccgg

SEQ ID NO: 1628 - DNA, 557 bp, Homo sapiens
gaattcggcacgaggaggactggagagacatggcagatgctacctgcacacttttggtaatattctgtgtgatgggatatgaaatggtccatagaaaaaaaccggaaaaatacgccaaggttaggttcattctaagagtctaaaaatttcaaaaaccaaaacaacattataaatggtgtttctcaaggacctttcactacctttttagattgtgcttgtgattttcaggcaagctaaatgtctgatgaagactgctcttcttttgttctgtgtctgacctactaattcctgcccatgcttcaaactcagttcagaaatcactgaaggaaccatccactgccggcctgcctgcaaccacagctgacagctgagttagttaggttttcctgtccctattatttaccagtttgtactgaaatgctttcatgggctgtgcttccagattatgagttctgtggaatcaggaagtatgtctctgtattcttgtattctttggcttttttgtgtagtaaagggactcaagtaatgttaaaaaaaaaaaaaaaaaaaaactcgag

SEQ ID NO: 1629 - DNA, 1320 bp, Homo sapiens
  misc_feature (1)..(1): n equals a,t,g, or c
  misc_feature (3)..(3): n equals a,t,g, or c
  misc_feature (52)..(52): n equals a,t,g, or c
ncnaaattaaccctcactaaagggaacaaaagctggagctccaccgcggtgncgtccgctctagaactagtggatcccccgggctgcaggaattcggcacgaggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggagtgttggtctaaacctgactggaggaaatcacctctttcttttggacatgcactggaatccatcacttgaagatcaagcttgtgaccgaatttaccgagtagggcagcagaaagatgttgtcatacacagrtttgtttgtgagggaacagtagaagaaaagatcttacagctccaagaaaaaaagraagatttggccaaacaagttctatcagggtctggagaatctgtcaccaagctcaccttggctgacctcagagtcctttttggcatctaacctcctgtggataagggctcagaatagcaccattgctgtgatgttgcacctgtaaccatctttttatgggtggagcagagagtcaatccctgcagccaccctgcagcgcatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgaaaaaaaaaaaaaaaaaaaactcga

SEQ ID NO: 1630 - DNA, 1271 bp, Homo sapiens
ggcacgagatcttgacagtattatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcagtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagagaacattttccagatggcgaggtcacagcagagagatgtggccacctagcctttccttatccccttcccttcccttcacccccatcctcttactcctttcatgtcccatttcagacagagtaaccattaacaaaaaaaaaaaaaaaaaa

SEQ ID NO: 1631 - DNA, 2455 bp, Homo sapiens
  misc_feature (1769)..(1769): n equals a,t,g, or c
  misc_feature (2433)..(2434): n equals a,t,g, or c
gggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagaraagggacggcaggatatgcgacagctggcgctgcgtctggcctcgctcttcccggcccttttcagccgtgagaactacggccgctgcggctcatcaccagttccaagcaccgctgcatggatagcagcgccgccttcctgcaggggctgtggcagcactaccaccctggcttgccgccgscggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattctycctacttatatnagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttaaaaaaaaaaaaaaaaaaaaaaaagaatnnctgcggtccgcaagggaattc

SEQ ID NO: 1632 - DNA, 587 bp, Homo sapiens
ggcacgaggaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgccaaaaaaaaaaaaaaaaaaaaaaaaaaaaaaaaaaaaaaaaaaaaaaaaaaaa

SEQ ID NO: 1633 - DNA, 1069 bp, Homo sapiens
cgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtawtagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgatgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgag

SEQ ID NO: 1634 - DNA, 2777 bp, Homo sapiens
ggcacgaggtcagcagccggctgctgagaggccggtagcggcggcggtcccgaggggcggcggccgcgctgctccctgagaacgggtcccgcagctgggcaggcgggcggcctgagggcgcggaccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagaggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttaaaaaaaaaaaaaaaaaaaaaaaaaaaaaaaacatccagcgtccg

SEQ ID NO: 1635 - DNA, 603 bp, Homo sapiens
cccacgcgtccggctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaaaaaaaaaaaaaaaaaaaa

SEQ ID NO: 1636 - DNA, 403 bp, Homo sapiens
ccacgcgtccgaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttgaaaaaaaaaaaaaaa

SEQ ID NO: 1637 - DNA, 2968 bp, Homo sapiens
  misc_feature (454)..(454): n equals a,t,g, or c
  misc_feature (1437)..(1437): n equals a,t,g, or c
  misc_feature (2961)..(2961): n equals a,t,g, or c
  misc_feature (2964)..(2964): n equals a,t,g, or c
aattcggcacgagatcctctggctgctctgctcccaccgcccggcccccggcaggccccccacccacaatgcacacaactggaggctcggccaggcgcccgccarctggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctntccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtnagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtaaaaaaaaaaaaaaaaaaaaaaaaaaaaaaaaaaaaaaaaaaaaaaaaaaaaaaacaaaaaaaaaaaaaanagnagag

SEQ ID NO: 1638 - DNA, 3021 bp, Homo sapiens
cttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtytcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgaaaaaaaaaaaaaaaaaaaaaaaaaaaaaaaaaaaaaaaaaaaaaaaaaaaaaaagggcggccgc

SEQ ID NO: 1639 - DNA, 3953 bp, Homo sapiens
gcggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgaaaaaaaaaaaaaaaaaaaaaaaaaaaaaaaaaaaaaaaaaaaaaaaaaaaaaaagggcggccgc

SEQ ID NO: 1640 - DNA, 3953 bp, Homo sapiens; identical to SEQ ID NO: 1639

SEQ ID NO: 1641 - DNA, 658 bp, Homo sapiens
gcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1642 - DNA, 633 bp, Homo sapiens
cccacgcgtccggccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1643 - DNA, 275 bp, Homo sapiens
ccacgcgtccgagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacacttaaaaaaaaaaaaaaaaaaaaaa

SEQ ID NO: 1644 - DNA, 1439 bp, Homo sapiens
ccacgcgtccgggctctctcatttccagcagacacccttcctcttacccagtggagaggactcagggaatcttggcagaaccctgctggcaccatcagcggcgtatgctcctcctcgtttctgtcttttcacccgttctcttctctcggtcttccactgtggagatggatgtggaacctttttgcttagtcctgtcttctgcctttcctgagattaccccaccgatctcctgtttgtgtctcaatatgttcttttctctgctcagatctccccattcttaaaagaactgtcccctcctcctcgcctccttcttcaattctgcccctcctgtgtctgagaccgttcacaggaacgctctgccaaggatgcctgactggcccccagcaagccactcctggggcccttgtgtgctggctcccttccagccctgccttcctgcttctgctctcagactccgtggtctctcttgggcttcagggcctgggacctcctggcagcagtgggctaccccaccccccaaccccacacacacgggaaaccaccctggtgaccagatatatatatatatatatatatacacatatatatatgcatgtgtatgtatttacacacacctgggaaatatatatatctggtgtatatatatttacacacacctgggaaactgccctgatgaccagagcacactgtctttctcctctgccctctgagcacctcaagctgctgtgcctggcgctcttcttctgttctcccctcacagaattcacgttcctccacagtctcagagaacatctttgaggaaatggtctccccatatgggactctcacttctgtcagtcctgaacatcagtgggtgaggacagggctgggcttggccctcagaagaggagaggagcacctgcctccggggagggtccctatcccaagaggtctgtccctaaggctgggatggggcttcttggtctccacaggttcactctccaccagccagctcttcttcctgactccctgtgtctgtgctgggcacctcctcctgctgcccaccaggcttggagtttgggaatcatctccaatacttttctctccctgtcctgcagctacctgtttgtttggtcttaacgggtcccccttccctttcctccctaccccagtgcccacagagaatatctaacagcaaaacgtacttttcctccactggactccaccctggcttggagcagatatggaattcccagttctgcccacagcctcctcccttagctcccgtccccagctgctcacccccaaacacccccatcctcctgccacagttttaaaaagtgttgcttggattgggccatcgcctgcttagaaacttaaatgtcttttgtggcttctcaaataaacatttaggcccttagtttggaaaaaaaaaaaaaaaaaaaaaaaaaaaaaaaaaa

SEQ ID NO: 1645 - DNA, 1020 bp, Homo sapiens
gggggacacgggaaaggcccgtgggaataggcctttgaggggaagcacgctgatctcttgttctgcagcgcatgcttgggatggtatgcgcatgccttctctcactaagactaggactgcttacagaatgcgaatataagtatccttatttgggagaaaagtacattttcaagggctggtaaaatgacgtggaggaagggaggatccagggagccttctgaagagtattgtcaggatgtctcttctctttcagccacctggatatgtttcacattttgtttcccaaacaaggactagattggatcccagaagggaatggtttccttagtatacattccgaattcctttgtaagggaaaaatccacttcatctggtctaagaatacataagaacaaatgaaaatgttgtggctggagatgttcctgagttaatatcaggatgtttgcctgctggtttctgttttaccaaacaaaacatagctgccaattcatccatctgtaaaagtgctccttgtggaccccctcaagagaagtactggttattttatttgcagaaaacgttttatkgggagttgttactttctgtgactgaagtggggaacatgagggtccctttaccgagccctcatattccatgtgtactctgtattttattgaggctgtttcccagtcagaacagcgtctctctttgtttgtcattccaaatctttcagtgtctttagggctctgagggccctggagagcctcacccaacctctcatccttccatggctgtccccacctctgtgcacttatgagtcaatgttgccgcacttcattacatgctgttcatattacagcattataagattttttcttttaaaagcctatcttcttcaatcgggtagtaagaccattgtgggttgaggcatgtttcatacttcccacataatcactccagacttaaaacagaaccggaaatacatgaaataaaaaattatttttctgttctcaaataaaaaaaaaaaaaaagggcggccgc

SEQ ID NO: 1646 - DNA, 1076 bp, Homo sapiens
gagacaataggggaagagatttttatgttttgttcactgctgttttcacagtatgttcaatggctcttggcacagaatagacaatattcgttgactgaatgctattggacattatctgtttattgaattagtgataaatattttaccctacgttgatataaatggacatattctacaggtaacaaccctttatttctaaagcatgatctcaatgtattataaattactgaagtagattagttcttttctttttttttttgagacggagtctcgctgtgtcacccaggttggagtgcagtggcgtgatctcgtttcactgcaacctccgcctcccaggttcaagtgattctcccgcctcagcctcccgagtagctgggattacaggcatacaccacccgcccagcgaatgtttgtagagacggggtctcgctgtgttgccaggctggtcatcaactcctgacctcaggtgatccacccacctcggcctcccaaagtgctgggattacaggcgtgaaccacctcgcccggccgattagttcttaaagtagtaatagacatctcccctccacctttgggaactgcctcctctagggagaagagtaccccgtgagttaggaagccaggtgatatggtttgaatatttgttctctccaaatctcacgtggcaatgtgacctcctgtgttggaggtagggcctggtgagaggtgtttggatcatggggcagatgcctcctgaatggcttggtgtcatcctgtaacaagtgtattcttgccctatttgttcccatgagaacctactgtttaaaagagtctggtacttcctcttctcgctctctctctctctcgcttctgtctcaccatgtgacatgctggctttccttcaccttctgccatgagtagaaggttcctggggccctcaccagaaaaaaatgctggtgccatgcttcttgtacagcctgtgggaccatgagccaaataaacctcttttctttataaattaccctagcctcaggtatttctttgtatcaacaacaacaacaagggcacacaccaaaaaaaaaaaaaaaaaactcgag

SEQ ID NO: 1647 - DNA, 1109 bp, Homo sapiens
ggcacgagctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaaaaaaaaaaaaaaaaaaaaaaaaaa

SEQ ID NO: 1648 - DNA, 1963 bp, Homo sapiens
  misc_feature (3)..(3): n equals a,t,g, or c
atncaagctctaatacgactcactataggggggggagcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtatygatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaaaaaaaaaaaaaaaaaaaaaaaaaaaaaaaaaaaaaaa

SEQ ID NO: 1649 - DNA, 808 bp, Homo sapiens
  misc_feature (794)..(794): n equals a,t,g, or c
gaattcggcacgagaaaagacctcatttataataaggtcactccaacatttcaccactggaagattgatgacaagaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagagtcaaaacgaggaaaagaggatggtgaacgttctcgttgcgtatanggccaggaaagttt

SEQ ID NO: 1650 - DNA, 1036 bp, Homo sapiens
ggcacgaggcggcttctacgctccggcactctgagttcatcagcaaacgccctggcgtctgtcctcaccatgcctagcctttgggaccgcttctcgtcgtcgtccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtatgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaaaaaaaaaaaaaaaaaaaaaaaaaaaaaaaaaaaa

SEQ ID NO: 1651 - DNA, 938 bp, Homo sapiens
  misc_feature (3)..(3): n equals a,t,g, or c
  misc_feature (28)..(28): n equals a,t,g, or c
  misc_feature (41)..(41): n equals a,t,g, or c
  misc_feature (43)..(43): n equals a,t,g, or c
  misc_feature (48)..(48): n equals a,t,g, or c
ttnaaggggagggggactaatgtaatgncactgccctatantnaggtncgcctgcaggtaccggtccggaattcccgggtcgacccacgcgtccgagaaactgcgcaactgcagttcgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctcaaaaaaaaaaaaaaaaaaaaa

SEQ ID NO: 1652 - DNA, 902 bp, Homo sapiens
ggcacgagctgacacactagtggcctcgagtcactgatagtggtgcctcctccttaccttggcaagcccttgtagccctctgagccctcatcctgcaggcagagcccctcagtgctctgagaaacctgccctgaactcaccgcctcccctgcctgggcactccctcctccctgcgcccacagcccccatgccaatctccgtcagctctttctgtgctgctgtaattgttggtttgcctgtctcctttgagctgtgggcattgccggggtagggtggtgtcttcaccacagctccagaaggcactggtgggatgtggagtcaggagcaaccagagaccccccaatactagaatgggtttgagcttggggtggggtggatggggaagacttactctgaatgttcgttcaccatccgtgggcaccaggtctgtgccaagcacagggactccaggggcagctgccattcgttccagtgatgtatttggggccttctcaggtgaggaagccaaggtggccaaggccctcggtcccctgccctgatagggcttacctgtgggtgggggagggagaccacacatgtcagaggtagtgaaggccgctccaaatagtgactggggccaggcaggcggaaaagagaacagaagagaatccagaagtgttcagacagaactagggacaacagaggggcctccatggtggcatgggtcagcagagcatggagcaggcagaggaagcctatctgtggggctgggtacatttctctgagactcacggaatgtaagtgttgaggtttctgcaaagagggcgcaggcctgcagtgacggttcagatattgataacccatcccccttggcaggtgggggcttaggcatccatattggattcaaaaaaaaaaaaaaaaaa

SEQ ID NO: 1653 - DNA, 1044 bp, Homo sapiens
cgggattcgcacgagagraaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaaatacaaaaaaaaaaaaaaaaaaaaaaaaaaaactcga

SEQ ID NO: 1654 - DNA, 1417 bp, Homo sapiens
  misc_feature (551)..(551): n equals a,t,g, or c
ggcagagctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggstcatccgcagaatcccctgctctggcttcttcagtttctcttccagacagacacccgcatctacctcctagcctattggtctctgctggccaccttggnctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactytacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccmaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctcctaaaaaaaaaaaaaaaaaaaactcga

SEQ ID NO: 1655 - DNA, 1377 bp, Homo sapiens
ttggcagtcccctgacaccctaagaccggcatctgtcgatgttatttccccagcatggccgaaacagaagccctgtcgaagcttcgggaagacttcaggatgcagaataaatccgtctttattttgggcgccacggagaaaccggcagagtgctcttaaaggaaatcctggagcagggcctgttttccaaagtcacgctcattggccggagaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaaaaaaaaaaaaaaaaaaaaaaaaa

SEQ ID NO: 1656 - DNA, 905 bp, Homo sapiens
ccacgcgtccggggatcagcgctaccaaggcgcacgagttctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctggggagaccatggatgtgcggaagctggacttccccagtgcttcttttgatgtggtgctcgagaagggcacgctggatgccctgctggctggggaacgagatccctggaccgtgtcccctgaaggtgtccacactgtggaccaagtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagaactcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagaaaaaaaaaaaaaaaaaaaaaaaaa

SEQ ID NO: 1657 - DNA, 1888 bp, Homo sapiens
  misc_feature (37)..(37): n equals a,t,g, or c
  misc_feature (1475)..(1475): n equals a,t,g, or c
  misc_feature (1477)..(1477): n equals a,t,g, or c
  misc_feature (1879)..(1879): n equals a,t,g, or c
gggggggaaatttgagggcccccggcccgtttagganaaattttgggggagttttggaatttttttttttttttttaaaaaaaagctggagttggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcytttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaargatgagtttgttgttttttgttttgttttgttttgtttttttaaagacggagtctcgctctgtcacycaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgkggtcgggctggtcnanaactccygaccycytgatccgcctgccytggcctcccaaagtgatgggattacagatgtgagccacccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgaaaaaaaaaaaaaatttaaaaactcgggggggncccggtacc

SEQ ID NO: 1658 - DNA, 1899 bp, Homo sapiens
ccacgcgtccggaagccggccactgcctctgctctgctcctgctcctgctgggcctggcctggacccaggggagccacggctggggtgcggacgcgtcatcactgcagaaacgtgcaggcagagccgatcagaactacaattacaaccagcatgcgtatcccactgcctatggtgggaagtactcagtcaagacccctgcaaaggggggagtctcaccttcttcctcggtgagtatgggggcctgatcttcatctggctggagagagaaggggcctgaggccagagggtatggaagggaccctgtggtggccactcagactttctctttttctggcaggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggtatgctctgggtgcgtgctctaaaggtgataaggaagaggggacctcatggtggggtgtggagaaagacccataataaagtgatctagggctgggtgcagtggctcatgcctgtaatctctgtgctttgggaggctggggtgggaggatcacttgagtctgggagtttgagaccagactgggcaatatagcaagaccccatctctaaaagaacaaaacaaaacaaaccaaaacaaaacaaaccattccagcctgggaaacatggcaaaaccccgtctactaaaaatacaaaaaattagccaggtgaggtggtgcatgattgtaatcccagctactctggaggctgaggtgggagaatcacctgagcttgggaggttgaggctgctgcgaactgcgattgcaccgctgcactccagcctgggcaatcacagtgagaccttgtctcaaaacaaacaaacaaacaaatgaaaaaccttagccaggcatggtgacacatgcctgtagttctagctacttggaaggcagaggcaggaagatcgcttgagcccaggagttcaaaactgcagtgagctatgatcacaccattggacttcaagtctgggcaacagagggagaccctgtctggaaagaaagagagaaagagagagagagagaaagagggaaagaaagcaagcaagagagaaagaagaaagaaaatgacctaggaccctcggaaagcaccttagggtgggaccacataggcacagctctgagaagatggtgttctagatggagcacagggaccgggatagagatgttacaggggaactgtggagaaaagagcctcctggtggaagggttcagaggtgggacgcagcgaggctgcatgggcgagaggtgatagcttggctcggcagaaccacaaactctgttttaggcggagcaaaagtgaggggcaccacaggcgaacaggtaggacagcaaaagaatggtgggtgcccagacgctgggtgaaaagatgccccgtttccgcaggcttaggagtggccacgtgctaccatttgattttctttcttctaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccctaaaaaaaaaaaaaaaaaa

SEQ ID NO: 1659 - DNA, 1987 bp, Homo sapiens
  misc_feature (435)..(435): n equals a,t,g, or c
aaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatgcaaatctcagtgttctcactatgaccactctgagcagagatttggnttttgtttccttttgtaacaaagtgaaaacaggtgagacaatgtgcccaaaacaaagggaagaagagaaccttctgtgactcctaaaatgttccatgctgcatttttgtttcattttttatttttccttgctttgtttttaaacatgaatataatgcttacttcaaattgtttagtaaaacaaaataactaaagaaatgtgagcttcccaaggtttctaaactatcgctgttgtatattctatagcgttccttattctttgagggaaactgtgcttgctgtgatccattttgtctctagcttctagttgtgattcttgtccataagcaccaaatttgatgcccatgatttcaaaaggtcattcttttatctgaatgaaaatggtggtactaagactgtgaaaattatgtgaaacctaaagtagttgccaaagtggctcagggttgtaaaattcattgacttaattattcatgtgccagatcaacccctttattttctctttagctgtgcatatttaaaatattggaaagtatcagatttacagattttctttgactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttytgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacacgtactataaaagtcagtctatgtacatactgcttattgatgtgctgtgatatgagggaatctgaaatgtttcataaaaataaagcttaaaaattgtcttacactggaaaaaaaaaaaaaaaaaaaaaaaaaat

SEQ ID NO: 1660 - DNA, 906 bp, Homo sapiens
ccacgcgtccgaatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaaatctggaaatagaaacaagtaaacccctgaaaaaaaaaaaaaaaaaaaaaaaaaaaaaaaaaaaaaaaaaaaaaaaaaaaaaaaaaaaaaaaaaaaaaaaaaa

SEQ ID NO: 1661 - DNA, 4597 bp, Homo sapiens
  misc_feature (562)..(562): n equals a,t,g, or c
ggggcgcggcggcagtcggctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgktagagcattgggaccctagaatagccaagaattatccacaagggagacacaacccntccagatgacattggctycagcttttatcctggaattgggaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgytacctaaagcacttagcacacagttaaattatatttacatcctagacccaaataaataggattgtgtgtatatttgggatatctattgaagaaaaaaagaaaaccccttaaarataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggamggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatattgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagacaatgatcaggccttaggaaattaatacagtagtagtaatcattttctaggggaaaataaaagaatarrtcactatactgatattttgatataagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttrttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatttatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgtaaaaaaaaaaaaaaagcctccctccgtgccgtcgat

SEQ ID NO: 1662 - DNA, 558 bp, Homo sapiens
  misc_feature (6)..(6): n equals a,t,g, or c
  misc_feature (8)..(8): n equals a,t,g, or c
  misc_feature (10)..(10): n equals a,t,g, or c
  misc_feature (33)..(33): n equals a,t,g, or c
acttcntnanggggactttcaactggaaattcnccctcactaatkggaacaaaagctggagctccaccgcggtggcggccgctctagaactagtggatcccccgggctgcaggaattcggcacgagcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctggaaaaaaaaaaaaaaaagggcggccgc

SEQ ID NO: 1663 - DNA, 1442 bp, Homo sapiens
ccagagactgcctcacacccctcaaccagacggccatgactgcccttttgtgaacacaatgtgaaagaagcctgctgtggtactgagcgtcsggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaattttcagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaartggtttactttgtagagtttacatggttttatgcgcacactaattgtaataaactatgccaaaccaaaaaaaaaaaaaaaaaaaaaaaaaagggcggcc

SEQ ID NO: 1664 - DNA, 1228 bp, Homo sapiens
cccacgcgtccgggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaagcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacaaaaaaaaaaaaaaaaaaa

SEQ ID NO: 1665 - DNA, 2241 bp, Homo sapiens
ccacgcgtccgcggacgctggacggagctgcggcggctatgctgtggagcggctgccggcgtttcggggcgcgcctcggctgcctgcccggcggtctccgggtcctcgtccagaaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcctggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgggtttttgtttccttttctgaagctgttcccccttttaaatatttttaatcccattgataaaatctatccttcaccccctttggttctactatagttgattttaattttaaatgtttaattgtatttgattaaacacttaactggattttggaataataaaactctcgtccaatttggcttttaaaaaaaaaaaaaaaaaaaaaaaaaaaaaaaaaaaaaaaaaaaaaaaaaaaaaaaaaaaaaaaa

SEQ ID NO: 1666 - DNA, 1577 bp, Homo sapiens
ccacgcgtccgcccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacctgtaaaaaaaaaaaaaaaaaaaaaaaaaaaaaaaaaaaaaaaaaaaaa

SEQ ID NO: 1667 - DNA, 2110 bp, Homo sapiens
ggcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaaktatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctatttkgtttttttgggwtttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggmawaaaaaaaaaaaaaaaaaaaaaaaaaaaaaaaaaaaaaaaaaaaaaaaagggcggccgc

SEQ ID NO: 1668 - DNA, 1825 bp, Homo sapiens
  misc_feature (270)..(270): n equals a,t,g, or c
  misc_feature (814)..(814): n equals a,t,g, or c
  misc_feature (1816)..(1816): n equals a,t,g, or c
  misc_feature (1825)..(1825): n equals a,t,g, or c
ggccgcgcggccccgagccccccgagccgggcggggcgctcaacaattyggyaastctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagnaccaggatattggattgcctagagcattttctttctgttatcagcaagaaattgaatccactaaacagacgttaggtagtagaaacaaagttttgcctgagcaagtttggattaaagtgggagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcarcgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaangctaaagctgaccagaccggactccttggtgacctgtcctgcacaggggagtttacagagcagcccctcgatggagatcaagtgatcggactgaacaggaatcctcggggggtgaacagccattccttcgtgacctgtgcaacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaawwtgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcacaacaggtaatagcaatagaygttagtgcaatacaaagtcaccctcaataaatactgttaattgggagatgtgagtttgtacacaaaacatcagactagacctttgtatgggagagaatttactgtacattaaattctttattttttgttaaaaaaaaaaaaaaaaaaaaaaaaaaaaaaaaaaaaaaaaaaaaaaaaaaaaaaaaaaangggcggccn

SEQ ID NO: 1669 - DNA, 1349 bp, Homo sapiens
ccacgcgtccggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacctcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctgaaaaaaaaaaaaaaaaaaaaaaaaaaaaaaaaaaaaaaaaaaaaaaaaaaaaaaaaaaaaaaaaaaaaaaaaaaaagg

SEQ ID NO: 1670 - DNA, 1273 bp, Homo sapiens
cttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaaaaaaaaaaaaaaaaaagggcggccgc

SEQ ID NO: 1671 - DNA, 1468 bp, Homo sapiens
aattcccgggtcgacccacgcgtccggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcccttgaatgggaaggagcagggattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatttcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagattttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcaaaaaaaaaaaaaaaaaaaaaaaaaaaaaaaaaaagggcggc

SEQ ID NO: 1672 - DNA, 1176 bp, Homo sapiens
  misc_feature (639)..(639): n equals a,t,g, or c
  misc_feature (700)..(700): n equals a,t,g, or c
aattcggcacgaggtttctctagaagtaatttatgttatcaggttatcccctgagttttttcttactcaccatatgtctggtggttctcacagccaggggcactgaggggctctgccctgggatctggaggccagcactgttcacctgatctccaccactgagatacctctggctagagccataatcaggtggcccaaaggactgaacaaggaagaatgggagggcactctagactaattaaggttgtcttttcagtctaaagttaacaatgacacacatgaattttcatatcagtataattagatgcgggtcccatctaattacagtgggtcattatggctgttcggttagagcagcttgggtgctctgtgaccatggcatgtgcccgtgtcaggactagacaaagtcatttgcttggggaagctctctccccttcaggtgtgaggccaggagcacctggtgtgggtcctgtccctgaggttctgtcctacaccaccctcatgcaacacctactacacacaggtgcacagcgactgtcacaggcgcttcatgtttaaggatgggcctccgtgtcataaacttttttaaagggtatatagrgatagcttatgraatccaaatcaaaggtccagagtttncagcaaattgtacctacctatttgccaacttaacctcaccatagaaagccaaaagattcancctgtggccagtctttcacattacagagtttaaagtactttttttaaattyctattttatttttaacaaaatatttaacaaaatatagtatatctcatgtgccaggtactatttgtaatatttataaacactgatttayttaatcttcacagagactcattttacagattggaaaacagaggcagagagaagttaagtaactttaatgtcactcagctgggtagtatcaaagtcttggctgctggctccagagtctagacctttaaccactgtgttatgctttccatgggtaaagcaacctaaaaaggcccctggaatcagttacatgtggttggagactaactctgtcattgacttactaaatgcttgatattgggcaatttatctaacctctctctgcatttagtaagtcaatgacagagttagtctccaaccactgtgttatgctttccatgggtaaagcaacctaaaaaggc

SEQ ID NO: 1673 - DNA, 1779 bp, Homo sapiens
cctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatatcttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgaggattttctgaatccctcatgataatttatagccacatactgcttcctttgacttcaggaatgatcaggtttcataatggccactgggcctgcttagattgcagtattcattatctgcatctaatttggtagtttccacaatcggtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaaaaaa

SEQ ID NO: 1674 - DNA, 1473 bp, Homo sapiens
cggggtggtaggcaaaggtgcttggggtccggccaacgcttgggctgggcacagggcggatcagtagattgggtcagataagacgccatttgaccaggttcacgtttttgtggatcgaggggtttcccatggagtgatataatgggggcgcctactaggaagtgcagtgttcagtggctttctctatctgttcctttcctcagcgcccagtgtagcgcgtggcgttccatataagttgtggaattgaaatggattccagggccatgccattccccttctctcattctcctcgctctccaccccccctcccccgccaatgtcctggaaggacgccctttagtgggtgcctcctaggagcttggagcagctggcagctctcttgccgggcttgcacggcacccgggctcagttgtaggtggtaagggggctggaagactgtgtccggctcctgccttggggattccgaattgaatccgcgctgagactagaacacgccctcccaagggagcagtcccagagtcatccacccgaggcggattaatcttctctgagtagaaatgtgaaaagcccacaccggccaggaaccctcgcttcgattcactttattttccagccagcgattttcctttgaacatagggatcccatccaggaggaggagacacagctcctagaaacaggatccgccgggtcctcctcctgcgcgggtagacgcagaacgttcccacagtctactttatgcgagcgtggcacccctgcttgaggcaccccagagcaccctcgggccgctccttttcacccgaaagataggatcaccccccagttaagtcgcttctgggttttccgaaactcacctgacactcccaacaccccgaccccgtcccggggctcgctgctgccacctactgcccaactcgaatgaaatttcagacgcatgatcaagcccagtttaatagggaggaaaaaaaaaaaccttttcttctccatgactggggctaagagctgttctgggacaagcatgtatgtgtgtgtggtgggatgggatgggatggggtgggaggagggggcagcaggggatttttctagctggtgccagagcagccaggcctcttagaggtggggtgagtctggccattgtgcaaccccttccagttcctctgagcagataatagctgaatccagatggtgacagcccgtgtgtcaccgtttccagttgagtctaggatatgagtaactggactgaacaaaaggcctttaaagagaccagccagcttcctagaagagaggagatgctactcattctaggggtggggtcgggtgtggggggataaacaaacaagtggaaaacccattcgcaggattccatacccttcctgtgagaattgtaactcaaggctgcttacacttgagtcggactgtaggcaggttgcttaaggctgcattgtcccagcctccccaaaaaaaaaaaaaaaaaa

SEQ ID NO: 1675 - DNA, 779 bp, Homo sapiens
  misc_feature (652)..(652): n equals a,t,g, or c
cccacgcgtccgcatgagtggtaggaaaggattactgtcaaaaatacctatttcaggtgtcacagtcaataatagcaagatagcataaattgactttttccgccctagggatatatagtttatcttcttcagatttctgaggattaaccgaagcaatttttaccagcattcacttcttcctaacgttgtcagactgccctccttcaaggaaatctcaaatctcttctggaagtatatgggacatgaaatctagcaggttaaaacttactataaatgtgtcatctgaagaatgcaatctcatttcctcaaagatttccaccctgaccctgccctggacaagcacttcttgctttttagaagtaagacctataaatcctgtaagtaagttacagggctctacattaggaacaaccaggcataggcaggggkcttgtctccaaaggaccttcggkctatcacagcataatgctggcactaaacttactgtggtaaactacagcaaacagatcattagaaagacaacacgcaaacaatgtacaatgtaattagccttttctaaccagtgtacccttggcttcctaaacaataacaaaaacaagtgacacagaacacataacagtgagaagtaacgactagttcataatataaaagncctttatactttttcaataaatacggtatttggttaaaaaataattatgttgacttagwgattaaaatttgtttaaatctattactaaaaaagaacacgcaatgatacacaccaaatttaaaaaaaa

SEQ ID NO: 1676 - DNA, 1332 bp, Homo sapiens
cccacgcgtccgtttacattgactggtttatgaatgttaaaccagccatgcatttttgggataaggcacatttgctcagatatattctttttcttatcttccccagtttctctcattccccataatgctccagaatttctaattgccaaaatgccctttaaatacttgttcatgggttttatctctcacattctctccgctccttcttcagaaactcttcacctgtttcacttacctagtaaagagtctgaagcagatgactgattttacatttttctgggaaattcaagcagttcattgaagattatcttttggcattaagaaaatgcaatcaaggtcaggcgtggtggctcacgcctgtaatcccagcactttgggaggccgaggcgggtggatcacctgaggtcgggagttcgagaccggcctggaccaacatggagaagccccatctctactaagaatacaaaattagtcaggcgtggtggtgcatgcctgtaatcccacctgcttgggaggatgaggcaggagaatcacttgagcccgggaggcggaggttgcagtgagccaagatcatgccactgcactgcagcctagaaaacaagagggaaactccatctcaaaaaaaaaaaaaaaaaagaaattgcaatcaagtgtcacttaatgatggggatacattctgagaaatgtgtcattaggtgatttcttctgatgggaacatcgtagaacatacttacacaaatctagatggtataacctactgcacacctatcctatatggtataacctagtgctcctaggctacaaacctgcacagcatgttatgtactgaatactgtaggcaattataacactatggcaagtatttgtgtatctaaacctatttaaatatagcaaaggtactaccgtagtaaacttttatgggaccaccatcataaacagagttcatcattgacctaaatgtcattatgcagcagatgactttattcaatttatatttaaagagaaccacagttctgatatgttagacattagtaatgccattcaaaaacttgagtcaaaaactacataaatatttctgaaaatttaaaaaatgtaaatgtatattacaaaaagccaaaagaagtagtaaaaagccaaaaaagagtaatatcaatttcatttaaaaataaactgaagtggctgggcacggtggctcacacctgtagtcccagcactttgggaggccaaggtgggcggatcgtgaagtcaggaaatcaaaaccatcttggccagcatggtgaaaccccgcctccactaaaaatacaaaaaaaagaaaaaaaaaaaaaaaaaaaa

SEQ ID NO: 1677 - DNA, 2129 bp, Homo sapiens
cacgcgtccgcggacgctgggctgttttatgtgtgtgtttgtgtatgtgtggtgtgtgggggtgactgtgagagtgtgtgtgtggtgtgtgtgtggcatatgggccaactattatgaatgtgtgtgtgtgtggcctgtagggtgactattttatgagtgtgtgtgtgtggcatgtgggatgactgttttatgtgtgtgtgagtgtgtgtgtggcctgtggggatactatgagtatgctggtttggagtgtgtttctttgggcctcagttttctcctctgtggaatggggatgatcatggcgtctcgtcactgggccgtgtgaggatcgaaggctgtgttgtttgtgcagcaggcagaagggatcctggtaggagcccacgcgtgggagcctctcatgcgccatcatcagtgtctccaagtgggtccgacatggtgggagcagctggctcggcctgtctccctggcagccccttccagcctccacaggtggtcccggctgactcatggcctgggagggctagggtgggtgggaagcccgccctcgagactgtctctgcccggctctggccacggagtgtcccctgtgtccagcactatgtgcccctgtgctcctgagtccggaaacagttctgtggggtccacatccctcccccatctcatagcagaagggactgagcgtccaagtggataaaggatgaggataaaggaccgtgccaaagccagatgcctcccagcgagggtcacaatctcgcttccacctcatgagtggctgcggcgcctcgggaatgaatctgttccatgttctgtgttgggagctggcgctgggggaccacaaccctcaaagtccccagcaccaaggcaaagtgcctggggctcaagaggggaagcccacctgacgggaagctgagggcagggcctgggtcatgtccccactggctgcaccctcaggagggcgggatccatcaccctcatccccatgcagggaaaggcccagggaccaggtcagaatgacacagagcccttgagctgatgcctcccctgacccctcactgagggccatgctagaaggggggatccctacaaaaggggaaatcctgaggctctggaccgggcctccagtaggggctgtcacccctggctctgaccttgctcccggagcccacctcccctgggtcgcctcctggtcatgggagcctccctggggaagagccactcctagtgtcctagagatgtggccccaggcgctttctccaccaggctgcaaatcccttcccaagctcacatcccccaagtcgtcatccagcccaagccgagcccccagttgcaccccaaggccttagcacaaggctgcagctggtcctcgagccatgatggacacttaactcctgtcccatgcatgtgccagtgcctcacttactcaccttggtgaatccttacagccctgaggaggtgcctgttcctcctcttctccctttttactgatgtggaaactgaggctgaggttaaatcactcactcaaggtcacacagctgttcaatggcttagatgggatttgaacagaagtctgagtgagtccagaacctgggacttcagccaccgggagtgtggctcccaactgtacatgcatgcatgtacacagacacacgctacccagacacttctcacacctgatgtgcacttgggagcagtgccccggctcccacctgttctcgtggcacatctgggtagagcctgggtgttgctggtgcctgaggcttgcgtgagagctttccacttttccctaagtctcccatcaccactagggttatgtgaattggctgcgcgtgatggctcatacctgtaatcccagcactttcggaggccgaggcgggaggatcacttgaggtcaggagttcgagaccagcctggccaacatggggaaaccctgtctctactaaaaatacaaaaattagctgggcgtggtggctcaggcctatagtcccagctactcaggaggctgaagcatgagaatcgcttgaacccgggaggcggaggttgcagtgagccgagatggtgccactatactccagcctgggtgacagagtgaaactgtgcttaaaaaaaaaaaaaaaaaaaaaaaaaaaaaaaaa

SEQ ID NO: 1678 - DNA, 2332 bp, Homo sapiens
ccacgcgtccgcactatcaaataaaaatagggcatttcttatggtagatgggagtaagaaatatcatcttctgtttttaaaaaatgtaactatataaatgttaagaaagaaatctattgaataaaagttggagaaaaaagaggatggttgattttaaactctactgacttggttgacttttacttgatatgtgctatctgaaaaaatggacaatggccactccctcatttctttttttcttccttttattgaattttaacagcagttttgtctggctcttttcatttctgtgtttatttcctgtaaaattgtgatgcataatcagagtaagtttttgtttgtgtatgattttgccatgaaaagtcactgtgtatctgaagccaaaattacacttagtatttcatgcggttttggctgatttcctttctatttttcttcattaagcaagtgccatcaaggccagcagtacccatattatatgtccagagaagagccaggccagatgggaactgcgtgaaagcaaccagttatcttgctaattatgccagctagaaccagttgtattgcattaaaaaatgtggaatccaacaacttagctgttcacactcaattagcagtgtgctggagaatggaaaactcaagcaaggagtccatgtgctccaggaagtgacagctgcttccttacccagcatttaatatccatgtaaaattttttcaataaacgttgtgataatttttgcaagaatcatgtatatgttatgtctctaattcatctcataatttaaaaaaaacataaagttcagtggtctatctccactttataacctttctttagcccacatgaagaataaagtgcaaaagtaagccacaaattcttgacatgttttcaaaaagaagaaatcagtagagaaaggagaaaaaaatcaggaagacaacaattagcgtatttatcataaatgaaggaaataaaacatcgagactaaaagaagactcaagtgtttcatttgtacatcttctgagataaaaatagctggaaacggcaactcacttcactggcatttttcgttccactgtctgtcacagatgatgccgagtttctctttctgactgatcttcaagctgaaggtaatgtgacagcaggaacattacaattagtatgcgaatacctatcccctgggttacaaattggcattctttaaattctgctattctcagcttttttatttttgttattaacttttcattggtcaaaacacttaaacttctaagtaataaataactctttgaataaatgtgacatttctctgagtctgtggcataattgaaataaattccatctgaaagttttttctgaagttcatattcatctgtttgcaagacaactattgttcacaggaggttaaaccaatatataatgatatacatattataaatatacatatttataattaatattcacctttaagtctttaatctgcctaagagatcattttgttttcctttgttctttgattttcagagaatctgaggagggctctacctttagtatacttatcttaaacaactatatatgtttaactatttaagcaattttattcatgaactaaaatgttctaatataagacattgcagttttctttgaaatttatgcagtttttattgcttaataacatacatttctctcttttaaccatggatctcaagtcattttatgccaatatttctttatgcaatatgatgtttaatgtaataaggctaatatatttatcaaaacaaagaccatatattggcaattttaattatagttaaagttttataacttcatgctttgtcaagcttttatctcaatgtaatacagttctttggtagtaaaattcaactggtatgtgtttatgaccctcaatgtcaattaaaaactcttgaaagattgacaatttttcaggtgggagaaagaaagcagtcaaaagaaggtaaaaaatgttcttctccttgacttaccgtggaaatgccctagttgatctatagaaatggttagtatcagtggccctggactaatgaaactgagagaagtagaagaaatgacctaaaaagtcggtgtatcattaagaagggaaatcatcaatcagcacgatcccttttgttaattcaagcaccattaagtaatgttcttaggataagcaaaaactgaatcattaaacatattttcactttttgttttgctcaggggggataatgaagtattaattttataatatatgcttgaaaatagtacagtttggaaaatacactgtcaaaatttaaagaccctcttggttaaaaaaaaaaaaaaagg

SEQ ID NO: 1679 - DNA, 1907 bp, Homo sapiens
  misc_feature (24)..(24): n equals a,t,g, or c
aagtcatattactaaaagtttttnccgttcaggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttcttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcgtgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgmcaaactttttttcagccatgtgtcctttgcctatgctgktttctctgctaactttctcttttttttctctctcttacttgctgcttttatggtcaagttctaactcttcaagcgtacacttaaatagtaccttctytgaccccgtaggctaggttgattgcttcagtgtactaaggcaaaaataccctgagtatctgtgctcattaacctctgtgtttcccttttgtaagatttatcacaattgtaatcaaatatttatgctatgatatattggttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggctctgtccagttggcaagtggaattcattggatgttttacaaagaatagttttagtaaggkggtggggacggaagtgagtttgcaaagtatcttataaaaagctagacttaattactcatttacgcaacattggaacccttacaagtgatttctctrctgagagcaacttttcttgagttttactaactcagtagacactgtcagaatctgccagattacaacaaaggggtaaaaattcctgatcacttgaggkcaggaattcaagaccagcctgggcaacaaggtgaaacccgatctctactaaaaaaaaaaaaaaaaaaaaaaaa

SEQ ID NO: 1680 - DNA, 1639 bp, Homo sapiens
  misc_feature (1623)..(1625): n equals a,t,g, or c
gaactgtcagactctcaagtaaaagcagccagaaaggggaaaaaaaggtaacagattcagcattgtccaaaagttccagaccagtgattaatgtgtaagataatggacttgggaaatgagtaaacactccccatgctccctgctttgtgcttgaacgacttgatgacaagggcagagcaaggtgagaatttaaacaggaccacaggaaaaaaaaaaaagacaaagactggcaacaacataatgcgagggagggggagtttactggtttgcagtctaaaaggtacataataactttcttcaaagcaggccttaacagtgtactaatttaaacttcaacatgggcatggaattacccgtagaaattatatgccactcagtcatcttttaatataccggatatttatatgtacttgttttcatttatttgttgttaacttccttcggcagacccattaagcatttagatacatatttgtgttcagatgtatcatcctcagggaaaggagatgctgtattttgattaagtggtgcatttcaaggtatttcaagctattcttaaataattatataggcacattttagagtattcctccataaaaaaatatttgaggatctggatgccttgctagctgtcgcactgcatttcttagcaatctgtcatcacttgaacttacacttttcttgatcacattgaagacctttyatatgtataaaacatttatttactttgaataaaacttgttttgtttccaggttctcactccctgtatttctttagacacctacagaggtgttttccagggatctctttttataggatcagtagcttaaacatgttaattttgtcagtgttttacataaaaatctatttctgctctgtcaatctgttttaaatgcacacatcacaactgacacccactgaggatttatttgkctctaaaaaaatcctgacaatttctctggacaaatgktacccattmccttaaacggtgcttaatgaactttgagcaatggccatggagagactgtgktcacagscctaaatctctatawtgttgtcaggtaatcaagtcttcggtggtcaatttaaaaatatttgaaattatcatattggttctgaatacaatattcatcatttttcttttaatcatagagaggtttgtaattatgtttatgtatattttgtaaattaagtccataatttaaaaaatcttgatattgcatcttcctaaaggcacttcagtgattcaaccctgaaaagcatgataatacagaaatgccattgtgattatcaacaactggattgctactttcaaagtacctttaaggccaggcgtggtggctcacacctgtaatcccagcacgttgggaggccgaggtgggcagatcacctgaggtcaggagatcaagatcagcctggccaacatggtgaagccccatctctacaaaaatacaaaaattagctgggcataatggcgggtgcctgtaatcccagctactcaggaggttgaggctggagcatcgcttgaacctgggaggcagagattacagtgagccaagattgcaccattgtactccagcctgggcgacagagcaagactctgtctcaaaaaaaaaaaaaannnaaaagggcggccgc

SEQ ID NO: 1681 - DNA, 1858 bp, Homo sapiens
aattcccgggtcgacccacgcgtccgctggtctgatctcagcgctccttggtctgcttgcctctcccaggacgcctgcacattacctctccatactgcagccctttatatggaaacttcctacatcactttgctgtgtgtgtttacacatgtgggttttgctgtacttgccctgacagcacacgggagtgcaggccacaccccaacccacaccaactgccactgaagacagagccttggtgggcacagaaccaagaaccccacccctgccagcacctaacccttgagctaatgctgtgcagataaatagggaccttcttataccctgagtgaccacagttgctttgaggggcacagagaaggcaccatggcctgcactggccagcagcccaccctgaaccaacactacctccagtgcaacacacacacagcaggggacccctggcccacaccccagctgtcttgcctccaccactgggtgaacgccctcagggaggcagggaattttgcatccactagcattctgccacagttgccacactttggtcccctcagtgcagtggactccaaacctccaagagccagggaacaaagttggggcccaagacaagttccccagatttaaagcacacagtccaggaattgggagccgcacattggcccccctaaaatcctccaaaaacaaagccagttagttgaatccaccttatcccacaatgaaactctcaagatcatcaaatacaataaaagaaaaatactctgtccgaaagtcagcaacctcaaagatggaaggtggataagcccataaagatgagaaagaatctgtgtgagaacactgaaaactcaaaaagtcagaatgccttctttcctccaaatgactgtatcaactctccagcaagtgttcagaactgggctgaggctgagatgtctggaatgatacaagcagggttcaggatatgcgtaggaacaaagttcactgagtgaaagaagtatgttgtcatgcaatacaagtgagctaaaaatcattgtaaaacattgcaggagctaacagacaaaatagcaagtataaagaagacataaccgacctaatagagctgaaaagcacactacaagaattttcataatgcagtcacatggtgattatgtgtgactggattatgaaaattattgtagtgtgtgtgggcacccgagattgccctgtaagcaggtgtggccagacaggggtcctgggagaggcaagcagactaaggagcgctgaggtcacaccagttccatctcatgtgcaagaccacccagcagaatagaccaagctgaggaaagaatcccagagcttgaaaactggctttctgaaataaaacaggcagacaagaatgggggaaaaaagaaggaaaatgaataaacaaaacatccaagaaatatgagattatataaacgaccaaatctatgactgattagtgtacgtgaaagagataaggagaatggagccaacttggaaaacatacttcagaatatcattcatgagaatatccccaacctatccagacagaccaacattccaattcaggaaatccagagaatctcagtaagataagccacgagaagatcatccccaagacatataatcatcagattctccaaggtcaaaatgaaagaaacaatgttaaaggcagctagggagaaaggcagtgtcacctgcaaagggaattccatcagacttagcagacttctcagctgaaaccctacaagccagaaaagatattcaacttcttaaagaaaagaaatttcacgtagtatggcagagacagatataccatataataacatggtgttattataaatgatttaaaaaaaaaaaaaaa

SEQ ID NO: 1682 - DNA, 1036 bp, Homo sapiens
aattcccgggtcgacccacgcgtccgagttgataattattgaatgtggataatgggactgttgtatatacttgtattctataattttaaaataagcataaactctcaaaaatgggagaggaaacggcaacaagattttggaagctggaggcaaatatattagtggtaactgatttaaccaacctgagagggctgaatcttaggtcagcagtgggaaaggcaaactgctttgctttacagatttcccaaatgtcttaggaatttgtgacatcaggaacctctggaagtgggtgtataaggatagaagctttcattcaaagcggtttaaaaaaaggccctaaataccctcttcagttccatgtagccaggatgaaaactgactcaaaattttttctctggaaagagtaaaatagaagtctggattgcactggtagttgagttgtagagctactaaatagggattaaataactgtgtgcattctggttgttctattactcaaggaataaaactaaagggcttgccccaaacctaaagataattacaggagaaaaaaaaaaaacccagccagttacccttcagtgagcccacaatcactatgctccatcccttcagtctccctatcaccttttttatttgtcacacttaaataagagcaaaaacagccaaggattatcaggcatctcaggaaagtctctaacatgaaagagagagacaaaaaaccattggctgggcacggtggctcacccctgtaatcccaacactttgggaagctgaggtggccagatcacttgaggtcaagagttcaagaccagcctggccaacatggtgaaaccccgtctctactaaaaatacaaaaattagccagccatggtgacatgtgcctgtaatcccagctacttgggatgctgaggcatgagaatcacttgaacctgggaggcggaggttgcagtgagccgagatcacgctactgcactccagcctggctgacagagcgagactctgtctcagaagaaaaaaaaaaaaaaaaaaaaaaaaa

SEQ ID NO: 1683 - DNA, 849 bp, Homo sapiens
  misc_feature (844)..(844): n equals a,t,g, or c
ccacgcgtccgtacttttagtagagccggggtttcactgtgttggccaggctggtcccaaattcctgacttcaagtgatccacccgcctcagcctcccaaagtgctgggattacaggcgtgagcactgcacccggcctcacttatcattattaaactctaacatgtgttgatcacttaaaactctcgagttgtactgtgtgacatgtgatagctaccttatttcattacttcatttattcccttgaggcttggagactgatgtgtgagggaggagtctgagggctcctgggccctcgcccatgggagctgggtgcgtggctgtcctgttgttaggacaagctgcaggagagactgtgtttccttggccatgtcccgtggggcccagcatgatgtcctgagtagcagaaagatgggtgagggatgggctgcctggatgatgactggctgatgcatttctgccctcagttttcaccatggccaggatctcttcagagtcatgattcaatggaatttataccaagtgtgccctgatttgggggtgtttctcagatgatgtgtagtgcccccactcagaggagccagaagccaaagaaactcagatacacttgattctctaattcattctctcacaggaattgtcttctaaactgcaaatattaaacagcgcagagaatggtctcacaagctcagaagggatctgggaggaaatgaactgctaagagggttattttcagctactttcacttactgctttaaactgtgcttctattgtttgaggtttttgcagtgagcacatacgacttatataataaaaaaaattccattttgaaaacaaaaaaaaanaaaaa

SEQ ID NO: 1684 - DNA, 1759 bp, Homo sapiens
ccacgcgtccgctataatcccaacactttgggaggcccaggcgggaggatcacttgagaccaagagttcatgaccagcctgggcaacatagtgagactcagcctctatttttaattgaaaaaaaaaaaaaaagcctgatgcagtttcatgttaaataatcagtattttttgtattattctgtctctcttcatcttacaaaaaaagtagctttgaaacaactaatatgctcttttttctttgcttctgctttcttcagctcttccatgtctataaagccaaccccttctgctcagctcactagaacaccttttccatgttatgaaattaagtgttgccacattctagagttgcaataaaaccaattgagatctttaatctaaatttgttgtaattttgtcctttgacactctgtaaatacggttttataatctgtgttttttccccactttatactatagacatctttcttgttaataatatatacttactaaatatgatgacatagaatttcattgtatgggctgtaccataatttaccaagccaaactcctgttagacatttagatttattctagttcttagctgttaacagtgtgctagaaatgctgtatgtgtgtgtaatttcacatatatataatcatttacttatattactagaatttattgttaaattctagacctggaatttccaggtttaagagtatgcacaatttatatttttaaacaccttgataaattgtccttcaaaagttgtatcaatttgtagtctgcttacatggagaaaattacaacctgctgtttttccactgatgtagtattagctttcactgagaaaatgaattggatgttttcttttttttcttcctaaatctcatatgtggtggaaagatattttcttttaaaaacacattctcagactgggtgcagtgtctcacgcctatgatcccagcactttgggaggccgagatgggtggatcatgaggtcaggagttcgagatcagcctgaccaacgtggtgaaaccccatttctgctgagaatacaaagattagccatgtgtggtggtgcatgtctgtaatcccagctactcgggaggctgaggcaggagaatagcttgaacctgggaggcagagtgaggcaagatcatgccattgcactccagcctgggcaacaagagcaaaattctgtctcaaaaaaaaagcggggggtattttttagtgcagagctccccaaagcctctaacatacttccaaatagaatgacttaagcaactcagaagaaaagtttttcagaaagacaaaagcatttatttgcaatagaggcaagagggcaacgggttttcccatgctcctgctcaatccctctcccagatgaacagatgatgtcttgccatccttaaacttcattgcaaagaaactggtttcatccacagctcccttcacattcccacccaatcccttagcttccattttggaccatgggacttgactcatagactggctatcaacctgtaacacagccaggtataaaaggatgacctgagcttgggcaacgcagtgagactctgtctctgcaaaaaaaaattttaaaaattagccaggtgtggtggtgcatgcctgtaatctcagctactcaggaggatgaggtgggaggatcacttgaattcgggaggtcaaggctgcaatgagctgtcattgcaccgctgcattccagcctggatgatggggagagaccctgcaaaagaaaaaaaaaaaaaaaaa

SEQ ID NO: 1685 - DNA, 2220 bp, Homo sapiens
ccgggtcgacccacgcgtccgcccacgcgtccgctaaaattaaaatatttctctgagcctccttcccttgccacatcagtggcctgggcttgcacttctaaggccaaaagcacaggcataaatattttgaggtgtcactttaaagagaacatgcatacatctctgttgccaccttaactttcctcctggcatgtgcccaggcagagttcagggcataccacaaatgcactcagcaatattcagggcctgatttttggaagcctgcttgaaaactcgcctgtaatttaaaatagtgagaccagaaattccagaaagtaccctagtttttgggaacgcctgatggcctgcacatggactcaatcctgattttcaaatggcaaaagctggggtggggggcatttaaaacttgctttttaaattgtgtgcttacttatactatctggtgttttatttgtttattttttctaacaatgtctcgaaggccatgagtctttaggcaaaagctgcaatttggaggtttaaagcaaagatgataaacagcatctaatcatcccattaacattttaccacttttctctctttttaacccaaagatccaacacagcaacaatactaattgatatggaagagtcaggccgcaaaggaggagagagaggtacagatagagcaaacctttgatgtaaggtcagggtcaaaaatgctggggctaggctgcacaggtgtaaagcctggcctggtcacttacccacctagtatgaccttgaacaagtcacttagtgtctctaggtctcagcttcctcatccatagacgtggatgtgatagtaatagactctgcctcaaagggctgtaggcagagtaaataagctaatacatgtgaaatgcttggaacagtgcctagtaagtacatggcaagcacaaggcaagttagcttggatcctcacccagtgctgcctcacttaattcactggccctgtgtccctgtttaacaatctatacacaaaaagtaagtagaatggcctaaaaaggcaaactgcctcctcaaaccaacaggctaacagagacagtgagaatggcacttatgggcatgcaaagagccatcaacgttgatgggtatacagcagatataattatgcaatattgccattaggatgccagaaagaaaaagcatgaataaattgaaatgttaatgacttcaagtgttcaaggaaatattccatttattatggaaaacaaatgaaaggcaagttaacctgtcatttctcctactcagagttagttcatcatgacttcatgtacggtaggatcgaaacaatttatggaaaatactaccaaagaaattaagataatgtcaatgcattacatattgccactggctctgagtttctcttcctaagctatcatccccaaagctttgatagttgtttgcacaagacagtttcagcaagaactcttcaaaaggaccctacgcccaagttctgtcagagaagtgaagagtgtcatctggaggaaaggttcagtgctggagagagcattctgctcagtcataaagcctgttaaaggaaggttaagaaggaagaccaggagtagcacagatggattctacagttctattcatctgcatttccaggacatgttgactggaccaccaggcatccagtttcgacttgttgggtcttgaggcttgttttccttgtttgtaaaatggggataagaaaataagaagacgaacaagcaggtcatggtgagaattaaatgagataatagatgtagagtgttggatgcagttcctagtattcagtattcagtacacagtattcaggaaagagtgtcaatatcattaatattaataagatatgtaaaataatttatattattaatattatcccaagcacttgagagtttccctgaaagataccaagaattctgagcagggggctggttcacaactataatcccagcactttgggaggctgaggcaagcaaattgcttgagctcaggagttcaagaccagcctggccaacatgacgaaaccctgtctctacaaaaaatacaaaaattagccaggcatgatagtgtgcacctgtaatcccagctactcgggtggctgagcatgagaatcgcttgaacctgggaggcggaggatgcagtgagccgagatcattccactgccctccagccggggcgacaaagtgaggctctgtctcaaaaaaaaaaaaaa

SEQ ID NO: 1686 - DNA, 2702 bp, Homo sapiens
ccacgcgtccgcggacgcgtgggtttttcgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccagttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattccaaaccttccctctaaatgggatttaacccacatctgcgagatcagcgttatgctaagaggaaatcactgaggccatatctttttacaatctgaaaaaaaagtagtaaaaaggtagttaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttggtctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaaaaaaaaaaaaaaaaa

SEQ ID NO: 1687 - DNA, 1785 bp, Homo sapiens
  misc_feature (936)..(936): n equals a,t,g, or c
  misc_feature (1004)..(1004): n equals a,t,g, or c
  misc_feature (1730)..(1730): n equals a,t,g, or c
  misc_feature (1750)..(1750): n equals a,t,g, or c
ggcagtatgactatagggaggctggtacgcctgcaggtaccggtccggaattcccgggtcgacccacgcgtccgaaaaaaaaaaaaaaaagagcagagaaaatgataaacaacttgcaggttgttgtgtggtataatggtcattcattattttctactctttctggtaaagagttggtgtgtcatggaaagtacctgttctatgtgtgtgtgtctgtgtgtataattcggtgtgaaaattaaagagaaaaaaacaataaaaaaccctttcctatacttatgtgtaaattaccatggtgtgctgcaaaaaacatatgtcaaggtgatagaattattttgactttcctgtacagttataaaatgactcagtgagtttggttagatatcctcgttctttgaatctatatccttgtctgcttatgatgaaaaaaaagaaaaaaaaataatggcgagggtcttccaaactctaaagaatatgtcaactatgatacaagtagcagttagccttataactaactgtaaacactgtctgtgggttttaagttttacctgagcattggatattaacagaccattagcccaactttcaaaaatatgaaccctatgaacttcacaactgaagtcagatctgtatgcctgagagaggtaaaatcatgtcatgaaatcaaacggtggctgatgcgcccaaattctggcctcatcctctaactggaggacatctggcaggacagcaactgggctgtgccttttttcagtccagcaacatcttccactcaacccacgccatttggcagtttccccattgcccctggcacctagccctccggtaccgggaactaaatatctttgamcatcccgcccgcggggtctgcctacttaacctgaggcaggtgaaagagcctcacgcagggttaggaactccgggggsgtggcgtancgtaacgcartgttggggaaacttgcggstgtggattgggggaccggaaagggaggggtgggccscangcgccggacgtgacgtaagccggaagcgactttccgccgagaaataaggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaaraaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgtttacttgatggaactttcagaagtttaatgggttaagggttcccattttttcaacatccagacntcaagatgggttacctattncccgttatttgggccccgaagggtttttaaaacca

SEQ ID NO: 1688 - DNA, 1162 bp, Homo sapiens
ccacgcgtccgcccacgcgtccggtgagaagctagctgagagaatgctagcagtgttccttcggatcaagttgagactagctggtacagttaagcctaagtttctttttgtttctttccttgcccctctcatttttctagactttgagaaatttacagtttggtagttaaggactatgtttgcaagcctaattcaaagcttttggggaatgagttgttttgttgtgcaaaagacaaataggaagtatatgactgtatgccttataggaatagaaggcagcagatagtatagctattttccatatggggaaactgaggcatgggagggttacttaatgaagtccctgatctctcaagaggcaaacattaaaaaaaaaaattagagaaagacgtcattatttgaaaatagaggtgagccctcctaaagctggtcttgagctgtttcacgtgttagtgctggcaggaggtaaccaggacggcctaaatcttgctttctgaaactcgttcatcaggcatttcctgagtggatgtgagtactgagatacatcatcagttctcccatgtgccacgtcactgctgacacgtccttagaaatgtctgatgtggtgttggctgatcttggtattgatcagttgtgaaagtggaagaggcatgagaagagacacctcttggggcacgctaaaatgacatatcgtgggggtccctggacaactttttattaggactggagccagccctaggaatatgtgttttaaataagtcttttaggtgattctgacgtaggtcatccaggaactcactttggaaagcattgtactagacatgaaataggagtggctggatgaaaaacaataaggaaaatttgccccggtgctgtggctcatgcctgtaatcccagcactttgggagacagaggtgggaggatcacttgagcccaggagttcgagaccagcctgggcaacatggtaaaaccccatctctacaaaaaatacaaaaaattaaccaagcgtggtggagggcacttgtagtcccagctgctcgggaggttgaggtgggaggatcacttgagcgtgggaggttgaggctgcaatgaattatgatggcaccactgcactccaacctaggtgacagagatcctgactcaaaaaaaaaaaaaaaaaaaa

SEQ ID NO: 1689 - DNA, 1024 bp, Homo sapiens
tcgacccacgcggtccgctgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaaaaaaaaaaaaaaaaaa

SEQ ID NO: 1690 - DNA, 2191 bp, Homo sapiens
ggggtccgaccccacgcggtccgcgtgactttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacmaatgtataagacmaatgtgctkgtycttttaaattctcctgkttcagaatctctttttaatctactcctaaggatgtacaagttagagtcagaagacgttttggattttttccctctctctcatsctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggtgacaaaggaagagttgggcagcagcattcaacaaacatccgtgaatgaaactttgctcctccattccgatatctgggctgcactgatctcgtgccgaattc

SEQ ID NO: 1691 - DNA, 1103 bp, Homo sapiens
gcattgataatattggtcctattaagtggtggtgtagagaagtattcacaaatttcaaaccaaaaaattatgtgaatagtaggggaattctttctgtacccttgagttattttatcactgttgtgwttacaccttataagamaattccactctgagaatgagcacaaggaacagataggaaatgtgcagctggtgctgatgtgtagccctgcgcccttcaaatccatgtgtgcaggcagtcacttcctcagtcattagcttttcatctgaaacaacaaagctagtggtaggcagcttctgagatggttcccagtgaagcctgcccgctggtgtgcactcttgtttaacctcctgtccttgggtgtgagctgcacttagtaacctgcttctaaggagtagaacatgggggaagggagagagcacacctgaggtttggtggcagaaaggctctggcttctgtctcctcgcccactcttaactttcatgctttcctgctcagaaggtgaggtgttctttggaaaggcccatgtgacaagaagcagaactttccagccgacagctamcatggaactgaggccctcattccaacggcctccaactgaatcctgccaacaagacatgagtttggaaggggatccaccccagtggaactcctgagatgattgcagccttgtgagagacaaaccaagatgtttgtttaagtgctaaacgtggggataatttttatgcagttacagataactaatacaaagctagaaaaagaaaaaggcataatacaaatttcagcatcttaatgagtctgccagcatctgaagaactgaaataaggcgaactggtcttcctcccgcatgagcacctgtcagctatcttagtcttaccttaaataaaaacacttaaccaaatacattatctctctcaaggacagcaaaagatattgaaatttgatgattctgtatttgaaatgtaaatcagattacaattaaactctaactcttgaatactgtcccttttaagtcaccaaatctcctttgagtaagatgaaattatctaaaaatgaataaaggataaaatttttaaaaaaaaaaaaaaaaaagggcggccgc

SEQ ID NO: 1692 - DNA, 1658 bp, Homo sapiens
  misc_feature (778)..(778): n equals a,t,g, or c
ggtccggaattcccgggtcgacccacgcgtccgagcacgtcatagccaccatacggagaagagtccagttccttttccctgggaacccccaacccacactcttcatcaggcaggtcccctggctcatgaatgcagaacaatcaccgcacccatggctgagcgtacccactggtagtggcctggagtttccctagggagaggctccaagaggcatatggctgtccctctgccactgccacagcaacagttctatccctacttccctcagcctggggaagaaacaaagagcctgaggcctataccaagtttacagcacaccacagtcaccatgtggagaagagaccaatctctcctcctagtgagccttcaactgcctttttccccagtaagtggaaccccacgcttcatgccagcagtgcagccatgccaaccccacagactgaacactcccagtaatagctgctctgtgtttcttgggggtggagcccccaggggcaactaaaagcctgtctgccattgcctctgatgtggtactacccctactactctcagactaacaaaggagcaagaaaataaatgccttatccacacttccaacaagctgcagtcaacccaaggagacgaggccagtctgtgtcccatgggtcctgcccatcccccctgctcatcaccaagcagggaacccacaacttgggcacagagcacacactctctatccttggctgattgcactgtgaaattgctgacctgcatctctctggggtggagcccccagganacaagcaaaagcccttggccacaaccattactaaggtccctttctctgtcctacttagggaggaaacataaaccatgagatcacctcaaagctgtagtgggcarcctgggagtgctaaactgcaatgtacagccaacattcatgtgggagargagcctacactttgagagctttgacagggagcatggttgcaactgtgaggaaatataggggagccacaagaacttaccagctgaccactacacctaagtgtcacctacaggataacattcgaaagcttcaacaccaaaaatatcttactgacatacacccctgcgaaaccaaagatgagaagtcagctacaaataaaggcctgcacgaagccatggccttgtgaaaacatccagaaaataagtctattgaaagtaaacaatttacactgtagttaaaggaacacctaaacmcagaagtgagaaagaatgaatgccagaattccagtamctcaaatgamcggagtgtcttatgtccttcaaacgaccacactagatctccaacaagggttcttaaccaggctgaattggctgaaatgacagaaatggaattcagaatatgactaggaatgaagatcattgagattcaggagaatggcaaaacccaattcarggaaactaagagtcacaattaaataatacaggatctgacatatggaatagccggtataaaaaagaacctaactgatttgatagagctgaaaaacacattacaagaatttcacaatgcaattgcagggattaacagcaaaatagaccaagctgaggaaagaaactcagaaattgaagactggctctcttaaataagacagtcagacaaaaataaagaaaaaaaaaaaaaaagggcggcc

SEQ ID NO: 1693 - DNA, 1167 bp, Homo sapiens
ccacgcgtccgcggacgcgtggggtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcaaccgcgacggcgcctcgtctcgcggcgccagggagttcgtggagcgggaggtgatcgacttcgcccgacggaatccaggggtcgtaatatatgtaaactcgcgtccgtgctgcgtgcccagagtagtggccgaataccgtgagtggggccgggctcgggctggagggcgggatcaggggctcgacccgctatcctccttctcgcttggtcgcaccggccagcttccacccactctcacccctcttctgccagttaacggggctgtgcgcgaggagagcatccactgcaagtcggtcgaggagatctcgacgctggtgcagaagctggccgaccagtcgggcttggacgtgatccgcatccgcaagcccttccacaccgacaaccctagcatccagggccagtggcaccccttcaccaacaagccgaccacgttccgcgggctacgcccccgagaggttcaggatcctgccccagcccaggtacaagcacagtgaagagttgccccaccaactgcagccccaggctttggactgttactccggtaaaggtggttcttcccctttgggattccaagcccaggcaaatggaacccatcaatgggcaagttgacagagttctgcttgggataatgaagaactgcctgtttctttccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcacaaaaaaaaaaaaaaaaaaaaaaaaaaaaaaaaaaaaaaa

SEQ ID NO: 1694 - DNA, 1671 bp, Homo sapiens
  misc_feature (1050)..(1050): n equals a,t,g, or c
  misc_feature (1478)..(1478): n equals a,t,g, or c
  misc_feature (1541)..(1541): n equals a,t,g, or c
  misc_feature (1632)..(1632): n equals a,t,g, or c
ggtcgacccacgcgtccgctgacctccaaaacaactttgagacaccttctgagaaccgttagcctgccagctcacagtgtggaaaagccccacgttgaactgttgctcttttgcagcagctcatccctgggatcaccccaggccatgctctctctgctcagcctgtgccttcttaatcctcaggcacctgttttgcctgacagtggtacgtgcaccctcccgttacaaagtggtgtgctgagggcactcagaaccatgaagcatgcatggtgcatcttcctgagtgttaattttcctcactggctattatttaatccactacatttttatagtaaaagttaacatagttctaattatacaccataggttctgtctgtccttctcaacaaaatctttttttttttttttttttcaaacagggtctcgcttcgttatccaggctggagtgcagtggtgtaataatagctcactgcagccttgaactcctgggcacaagtgatcctcctgcctcagtcatgcaagaaagtacctagaactacagatgtgcgctaccgtgcccagctaatttttaattttttttttctggagcagggtcttgctttgttgcccaggctgatctaaaactcctggcctcaagctgtcctcccttctcagtctcccaaagtgttagaaacacaggcatgagccattgtgtctagccaacaaatttttttaatgaccctaattaaacatgttcaattttttatgccaaaagaaaatagatgtactatagtttagaatgtaacatttgtgtacaatttttaaggaaaaaaataagatcaagaaatttaaagtttccatgggccacttagggttatgtctttagtcttcccargattatttggtccctcagctctgaattaggactactttgatggaaaaggttagaactacctatttaagttgtcagatttgtaattctgtattttggttttgttcagtggagctattataacatttttattcagcatggaataagaactggccatgggttggtctctgaatcatcangcttttctggttaaaggtaaacatataagtattttttcttttagccatgtttaattttgaaaaatgtcattaaagtaagcattgctgcattataaaaatgattgacaagtccgggcactgtggctcatttctgtwataccagcactttgggaggccaaggcaggtggatcacgaggtcaggagttcaagaccagcctggccgatatggtgaaaccccatctctactaaaaatacaaaaattagccggttgtcatggcaggcacctgtaatcccagctactcaggaggctgaggcaggagaatcgcttgaacttgggaggtggaggttgcagtgagccgagattgagccactgcactccagcctgctgggtgacagagtgagactccatctcaaaaaaaaaaaaaaaaaaaaaagggcggccgctctanaggatccaagcttacgtacgcgtgcatgcgacgtcatagctcttctatagtgtcacctaaatncaattcactggccgtcgttttacaacgtcgtgactgggaaaaccctggcgttacccaacttaatcgccttggcagcacatccccctttcgncagctggcgttaatagcgaaaaaggccgcacccgattgc

SEQ ID NO: 1695 - DNA, 506 bp, Homo sapiens
aggttcactcgttcagcagacacgcatgggaactgatgctttgagttttcttctgtggggttttccctttctctggtctccgtgcagcccctgccctccctcgggtgctgctggcctcaaaggaggaactcgtggggggagggtgtgatttgcagacctgggtctctgctctgctctgggggtggggcttgctttcacagagaccctccttccctctcacccctcctctcccggcctcgccaggagtcttggctgttggcagctcagaggtgggggaggcctgtggtgtgaggtgccctgcacctgctcctgctcctgtcaccccttcctgctgcctcctccatgcccaaggaacacccatggtgcagtcctcaggcaaggccaggacggggctgaggccctgcgtggagatgctgcaccagcggaaggctgagacccgcttaccttagttcatctgttcactcgtaataaaaagaattctctcaggtcaaaaaaaaaaaaaaaaa

SEQ ID NO: 1696 - DNA, 1721 bp, Homo sapiens
cagacagccgagcctgcggaaggcggcggcggcggcacctgcgatcagcggctggggcaggttatggtagtgcggactgcggtgtgagcagagcggcmcacggggcccgccatgcgccggcggccctgacatgggcgccagcgggtccaaagctcggggcctgtggcccttcgcctcggcggccggagcggcggctcagaggcagcaggagctgagcaagctttggtgcggcctcggggcmggctgtgccccccttcgtattcacgcgccgsggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgcaaaaaaaaaaaaaaaaaaaaaaaagggcggccgctcgcgatctagaacc

SEQ ID NO: 1697 - DNA, 1994 bp, Homo sapiens
ggcacagcagcgggctaaaaccacgaggggacacatttggcgggagcttgccatgcgtcgtacacttgaggtctgtatgtcagtgcactgtccctgcatcggcccatttaatcctcgcccaaggtcacacagctcacaagggacagatccagaggctgggctcctgttggaggagccacacaccctgagctgtgcagcgtagaccagctcttgcacaggattagtgctcagtaaatggcgatgtgggttgttgctgttattgcaagcagtgccactctgggtttagctaaaataactcatgatctccaaagcaccctccagctctgattgtaggaggggggctgtcaggagctccatgcacacaatatggcagaggagctttgggagactgttttgactggcatctccttttccagcacgttgactggcagctgtttcaaggtctcttgaaagagtccctactccctccctaagctccattctctcctgggtttggatatgctgagagagggtagggaaaactgaaaggaacattgatcaagtggactggatctgttggcaggcaatggagatgtcacccttctcaaagtaaatcactgcaggtcaccattgagacgggacacaccccaaatgaggcatctgagacttctctgccttggggtgaaccaggcgcctcccagtgaaacccctccctgcatcaccctctgcccctctttgtgaggcctgtctccccatccccgcattcctcttgcttcagggacccctgsctcactggtttattgctaccctyctgccttctcctccctccctttccttgggctcgcatccctttgatgtttttacaagccttttttyaaacytgcactcactggtgggtgaatcgcctccctctccttgggagcattagtgcccttcctggcctccgccaagggggagggcggcttttatctcccagcggaatctcattagctttgccgcacaatgggaccgaacctcggctgccacagagtggatttaaattagttaatagcagattttttttttttttttgccccaggcctgttttttccaagtcttggatgctgagcaaaaaaacaactttgttgttgaaaaatgtaaaacaaaaaaatattgaaggtggagtgctttgacaagacggaagatcactgtaggtgaagttctcctgtgctccacagccacccagaggaattccaaaaccagcagtggaggacttggggaggacaggagggaaaacatggcgagttcatcagctctgyttcctttattaaaatatttctgtaattggtggtgggaaattgaagaaatcaagtgattgcatcagcgctggaaaaagctgccagcacttggcagtggaagagaatatatgctttatactggactttttgaaaaagaggctgagtttggccagattgccgaccagcaatggaaaaactaattaggtgccttgcctgtgagccagacgcccagcagggctgtggcgcatggctcccgccgcctctgaagaggacactttctagtgaattcagttcgtgctacccttgagcagcctgtgctacagcaggcacatttgtgaatctcccaacctgtgcctggcgtcggaactgtagcttcccaaagacttacctgccctgggagatggcgggcagctgctggccacagccctgggcctgcacctttatctgcaaactgggagagcggggatgggagtcagtgggtaggaggtgggcagaggcctgggcctcccagtgttcgggctcccacactgctgccctcacccactatgtgcatcttcccaacttctggacatcctcactcctcctctgtccaatgtaaatcagaatagtgggccgggcgcagtggcgcacgcctgtaatcccagcactttgtcaggctgaggcagaagaatcacttgagccaggagttggaaaccagcctgggcaatacagtgagaccctgattctacaaaaaaaaaa

SEQ ID NO: 1698 - DNA, 443 bp, Homo sapiens
ggcacgagaaacggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaaaaaaaaaaaa

SEQ ID NO: 1699 - DNA, 1560 bp, Homo sapiens
ggcacgagggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaagttgaagagctttgaggctcagcakcatgtytgtggcattcggtggacaccatggccttgggcggctggacaggtttttgtgatgtgagggacacgcatggggcacatggtaagcttggcaagggctccaggaacgctgacgaaaggttttaggacccccacccccatgcctgtaccaaggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgtgcacgcgcgcgtgtgcgtgttgacttcatggaattttgttttgtgaaattcccctccaatcgtgtcagaatttacctccatgccccagtcacactgttggttctgcgctctgaacctgggtgtagccatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggcccctccggtccacgtcaccctgagtacacccctctgattgctctgctgtcaagaagcacgtttccaccagctgtattcaacactacaatgcattttttaaactatatttgcatccaagacaataaagacaccttattttttttgaaaaaaaaaaaaaaaaaa

SEQ ID NO: 1700 - DNA, 463 bp, Homo sapiens
ggcacgagctggtggcgtgttagtttctgcccagttctaccccctcatgtgcttcttctgaatactgaatgtgactgttgaaagctggtagaattcatccctcttactgtagataacactgcaaatcttggaattttgttttttgctgtttccagatgtatctataaatatctatacattatatgtgtgtgtgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaaaaaaaaaaaaaaaaaaaaaaaaaaa

SEQ ID NO: 1701 - DNA, 477 bp, Homo sapiens
cggcacgagaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccaaaaaaaaaaaaaaaaaaaaaaaaaaaaaaaaaaaatgaaaaaaaaaaaaaaaatagaaacaaaaaaaaaaaatttctagggggggccc

SEQ ID NO: 1702 - DNA, 687 bp, Homo sapiens
ggcacgagggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1703 - DNA, 1877 bp, Homo sapiens
ggcacgagggggaatacgggctgtcagcaagacgctgcaggggtcaaggaggagagcaatgaaggacaggaagcagtgggcattcaagactcgctggccttttttccattttctcatgctttctttggcacttgactgctacaggtttttaacttcctgaactgtaccgtccatcatggaaggctctcctcacttactaaggctaaaaacacaggctccatagcctcttcattttatcacactaatggtcgaaaggttcttatcctattttgcatttgtttcttgaggggaacttgagaagcaaaactctggagccatgctccccacgtgcaaatctgagctctaccactccctgctctgtgaccatgggcaagtcacttagcacgctatgcctcagattcatttttaaaattaggatggtaatactagtatcttcacaagattttatgaggattaaattagctgttgggcactgttgtggttaatttcaggtgtcaacttggctaagctaagtgatacccagatagctggtaaggcattacttctgggcgtgtctgtgagagagtttctgcaaacattagcatttgattcagttgactgagtaaagaaaatcaccctcactgatgtgggtgggcagcacacaatccattgagggcccagatagaaagacagagtgaagggtgaattccctctctgcttaaactgagacatccatctcctcctgccctcaatatcagtgctcctggttcttgagccatcaatttgaactgggacttacactgttagcccctcaccccagtttctagccttaaggtctaatggaatttgactgtcagtcctgtctttcttttgatttctcccttttggaatgggaatgtctatcctatgcctgtcccccactgtattttaaaagtgcataactcgttttgtttaacgggtttatagctggaggggaatttgggctcaaaatgaatcatatcttaggtcccacccagatcagatttagacaatatttagatgagactttggacttagattttaaggttgatgcttgactttaaatgctattaggatggaacaaatgggaggacataaattttgagaaaacggggcgaatgctatagatggaatatttttgttcctccaaaattcgtatgttaaaacctaatccccaatgtgatagtgtttggaggtggagtcattggggggtgattaggttttgaggatgaaaccgtcatgaatggaattcatgcccttataaaagggaccccagagaacttccttgactcttacacagcaagaatgcagccatccatgaaccaggaagaggaccctcaccagacagtgtatgtgccatgcactttgatctaggacttcccagcctctagaactatgataaatacatttctattatttataagccacccagtttatgatattctattaaagccacctgaacaatgtaaggcaggaacatgataaatgctcagtaaatgttaagggaaaaaatcctccttgaaaacataacacatttattcagcatatgtctgataaaatccttgtagtatggagttgatatcagggttgtgcagttcatctccgtcctcacaccatgtccagcggcttcctgaagactctgcacagtgacttctatgtgaactgaagccagtgccacagtcaatacttaggaggtgatggtgaaaaacggtcatggttctgaaaataagccatgcatttgtatgttggaaatcttccctttgcataactggaaaacaaatctatgagtttttcagcaaaagtggagacataaaaaaatcatgcgggcctaaataaattaaaaatcaattaaaggcaaaaaaaaaaaaaaaaaaaaaaaa

SEQ ID NO: 1704 - DNA, 782 bp, Homo sapiens
ttccggcacagtrgggaaccacttgtttttctaaaaaatattgttctgtgatcctctgaagacaagctgtgatttgtgatgtttagtatgttagattgtggactggcatcttcttgatggagctgattctaaccttagaataatttttgctttcatcaatcttgtcctctgattatcaaattagggccatagctgtattttcatggccatattattaaccttcttagtttatgtaattattacatccataggaaaacagttacacaaaaagaatttgtatattttcaacttctagcagtttgtaattactcagctcctgaaattaaagaaatttaatcagttttagtcatcttgtcttggttgccatggtttggaaggaaataccaaatagatttgaatcagtagactagaaggctgctgtttaaacacatgaaataattttttaaaaagctttctgggttgggcgcagtagctcatgcctgtaatcccagcacttggggaggccgaggcgggtggatcacttgaagtcaggagtttgagaccagcctggccaacatggtgaaaccctgtctccactaaaaataaaaaaaaattagctgggcgtggtggtgcacccttgtatttccagctactttgggaggctgaggcaggagaattgcttgaactcaggaggcactctcatgaggcggaggttgcagtgagctgaaattgcgccactgcactccagcctgggcgacagagtgaaactccatctcagaaaaaaaaaaaaaaaaaaactcgag

SEQ ID NO: 1705 - DNA, 1003 bp, Homo sapiens
ggcacgaggaaaccttcctgagtttcagtttccttatttgtaaaatggagacaggagggaagaaagctaactcctgttgagtgcctgttatgttctcgggacagtgttagggaaatcagaggaattgttttatttaaagctgtccagtcctgcaagtaggtataattggcctcatttaatagaccagaaaatggaggcaccggagcctaacaattttctcggccccacacagctggtaagtgatgaagccggaattcaaatctgggtcattctgactgcagagccaatgcgatttttatggtgccagcctgttgcctccgtgtggggctcataacttactccacagcggtgtcttattcaagttcgtccagaagcagatcctgagatagactacaagtagtttatttaggaagcctgggaaacatcagtcaggcagtcaggaaatgagacagggaatgggaggcagcccctgaaaaagtgtgttatcaattcaactaccactgtaagctattagagcttgttcacactggggaggctctgggaaccagtggagtgcatgtacctctgaattttcccatctgaggaaaaatccgagggagccaaggtatttatacaccaattcctgagagtagttaactgagggctacttctgggaggtggagtgttctaataatttgtaggtgcatatgttgtatcccgtgcttggcaaagtaggactctagcagcacaagaaagtcctcagcagagaaattcaggtgctggcagttggaagcaagccactgtgctctgaaatggtaaggacaaaggagtgggagggatgccgaaagcacctgctatggtggttttaagaattagaaacaggccgagcatggtggctcacacctgtaatcctagcactttgagaggccaagacaggcagattgattgagcccagaagtttgacactagcctgggcaacatggcaaaaccccatctctacaaaaaaaaaaaaaaaaaactcgag

SEQ ID NO: 1706 - DNA, 1692 bp, Homo sapiens
ggcacgagctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggaaaaaaaaaaaaaaaaaaa

SEQ ID NO: 1707 - DNA, 1274 bp, Homo sapiens
ggcacgaggtgaggtactgttaggttggtcagactgatagtttattgtacgtattgctgtaatatctttgtacatttagcttttccatgtttgtaccatatctttgggttttcagaagtctgtctctctctctgtttctctttttgtctgtcttttctatctctcaccttcatttggggagcattttgtgttctctttcacaggactaattaagttttattggatcttgaaaaacgggattagaaattttttcttacttatataattagaaamcaatgcttttggacttacattgccacggcagtttacacagttttattcccaaaaattgtagttttgtgactaggtgataaaaatgatctcctatatgtgccaaacttggtattctagacactcatacttaggatgtaaattgactgtagtccaataatttaatatgttgtgtttaattcttgtaatattttactcacaaattgaacttttccttaccaatttaatgtttgtaggcttaatttggcatctttgtcaggattattagacttctctgcattcttctgacttctccctaaactaatgtttagaactgaattgggtccagcaatttaagtggaaaatcagtatgactagagacttctagaaacttctggtgtcactgagatggtgaatttgatgattctgaccctacttgctcatctgtaaaagctattagaggattgttttaagcatttctattctatacaggtatatgtacaccatgtaataccactcagccataaaaaagaatgaaataacatttttgcagcaatttgggtggagctgtaggccattattctaagtgaagtaactcaggaatacaaaactgaataccatatgttctcacaagcgggarmtaagtcatgggwacgcaaaggcatacagaatagtaaaatagactttggagactgagacgcggggagaataggaagaagataagggataaaaaacgatatattgggtacaatgtatgctactttggtgatgggtgtagtaaaatctcagacttcaccactatacatttcatccatgtaacccaaaaccacttgtactycaaaagctattgraataaaaaagatatttaaaaaaaaagaggccaggcaggttggttcacgcctgkaatcccagcactttgggaggctgaggcgggcggatcacttgaggtcaggagttcgggaccagcctgaccaacatggtgaaaacctgtctctactgaaaaaaaaaaaaaaaaaaaactcgag

SEQ ID NO: 1708 - DNA, 1601 bp, Homo sapiens
  misc_feature (12)..(12): n equals a,t,g, or c
aaggaagagaantagaatcagaagttaggacatctattgcttgatgcttctgggatgggtaagacgtagttctggtgatagaagttgaagctgcagcataatgagagatgaaagagaaactgctcttctggtgattttaaccctagggatgtagctactgggacaggaggaagtgagggacccagtgctgcagggtccctgttgtcacatatgtcaatcctactttaaagtcaaataatggattctggctgataaagcctatcagaattatggtgttgatacgaaagtgtcacatagccaccaaaatgtgttctctactttcttgctttgctctgattagctaagtcttggtcacatggctttatagcactgggaaaaccaggatctggtcttttatagggtaggaagtgagccctatcttttgtgtagatttgtggcggggagtttcccaagcatgggaaatgggctcagatgatgtggttataaaatgtgaatgtccattaaaaggcagtcagtgttggctactctaagccttcaaattgttgcttttccccttcaacagggaccaaggggagatactggaaacctctgagcttcagctgttggtttttgggttttgtttttgttttattgagatacagttcacttaactatacagtttacccatttaaggtatacagtgttttttagtaatttacagaattgtgcaactattmcaattttggamcatttttgacacctcccccccaaaaaaaccccwatgccccttagcagtcatcctcagtctcctcagccctaggcaaccactcatctactttctgtctttatagatttgcctatttgggacatttcctataaatggaayctgtatgtggtctttscttggttttgtttttggggtggtgggggctgactacttagtcttgacaagccaaggtcccaacccagcagtagaaatataaggagtcacggctgtgaggatggcctcacaatgggctcagggtagtgaacttctgtcccctaagttatctcagaaatgaggccaactctctgccctctagaatggatggccctgagggagagaaaggttcatgtccttcctggctggtgacagaaggctggactgtgcctgaaatcaaagcttctcacctggatttgggcaaatcaagcagtcccgaatctcagggtggggtgagatgtgtgctgaagagggcaacacaggagctgcactgcagatggcgacatgcagggtttcaaggccaaagctggtgtgttcttcccttaagaattgctgtaggctaggtgaggtggctcacgcctgtaatcccagcactttgggaggctgaggtgggcggatcacctgaggtcgggagttcgaaaccagcctgaccaacatggagcamctctgtctctactaaaaatacaaaattagccgggtgtggtggcgcatgcctgtaatcccagctactcgggaggctgaggcaggagaattgcttgaaccccggaggtagaggttgcagtgagccgagatcacaccattgcactgcagcctgggcaacaaaagcgaaactccatctaaaaaaaaaaaaaaaaaactcgag

SEQ ID NO: 1709 - DNA, 766 bp, Homo sapiens
ggcacgagtccatgagaagcacccgggcaaacttgctggctatatatccagcctgctcaccctgacaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggttccttgggagtaggtcttcgaaacttgtgtggccagagctcccagcccctgaatgaggaaggatcagagaagaggctactgggggagaattcagtgcccccttcaccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaaaaaaaaaaaaaaaaaaaaaaaaaaaaaaaaaaaaaaaaaaaaaaa

SEQ ID NO: 1710 - DNA, 3237 bp, Homo sapiens
  misc_feature (1)..(1): n equals a,t,g, or c
  misc_feature (6)..(6): n equals a,t,g, or c
  misc_feature (32)..(32): n equals a,t,g, or c
  misc_feature (3237)..(3237): n equals a,t,g, or c
ntccgnaattcccgggtcgacccacgcgtccngcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagatagsaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataan

SEQ ID NO: 1711 - DNA, 2070 bp, Homo sapiens
ggcacgagcccagaagtaaagaaaagggagggttttaaaataaataaatacataaacagggtttttgttttcattttcagaaatatctctaaaagcaaatagttttacagcgatatcattatatgtgttaaacttccagctctctgagtatgacttctgcatttttatttttatttttagattcagttttgttcacttgggcatgtgtatggcttggagacaggcaggaatgccaaaaagctggtagatgatggcaactgtgatgagcagaagaactcactgcctcagttacctggatgtgggccattttctttccctggagttggagggcgggcaacaatgttgaaactggctggaagttgagagagaaactgaatttgtttcagggcctagtgatattttagtgcataattttataaaataacagctccatyccatgaatataggagaggaaaaagattattgagaaaataatttttttacaggcactggtacttttttttcatgttttgtgttgtagttgcattttactagagcagctgacaccattcctatgtggtctgattttgtagttcaaagaccaaaaccaaataaaaagatctactctttaaaaactctcttttccaatgagaggattatggaaaaagtgacagtgattgaaagtctgtgttctatttgccagagtgggggagggagtggtaaggcaggttgactgggatagaccagtcacgaaggagctggaacattcacccaggcccattgccatgtgamttgtagaaggtctgtggggaagacaccatctgccactgtttggcaggatttggccaccatggcacagagtgggcaattgtcctcaaccttggaggcagaagctggcagctggccaaaagtctgctttctcccagaagagataggcagtyactgagccgagatactgatgatgtctctctcttatcgtgcaacatggagagcgggagaaaatgagggaggacagaagagaggagaaggaggaggaaaataagaaaaggaatactaattaactcagcctgtctatccagctaagcttgagcttgattttgctctctagttgaatggaacatgcaacctgaatttctgaataacagaattaccaaattactgtttaagtgtttgagaaaaaaaggtgaaaagtgtgtgtactatatgtatagacgtatagattgacatatagtgaattggttaattgaatgtctgcatcagataagaaggtgttaggtcaatttccacaataatgccattaaaatcggttctttgattaaatccaattaacagatgtggaaactgaggtttgtgacaaggttcaatccctgatttctgtgactccaaagtatgtgctgttatttaatgtttatgtattctctattatgaattgttttcaagttttttaaaatatcactagctagcctgtacgtttcttaggaggcaaaaacaattgccttaaattttgttatattttagtgccattttgcacataggttataagcaacagataatttctgtaatctttagaatatcgattaaacttgttaaaatgtagatattttgaaatctcacacaggacacctaaattatgtraaatgttataaactttatgatttacaggggccctggagatggaagtyctgaaaaaatgtgcctttattcagtattagtgcattatcagggattccagatytcagttaaaatgagagaatctgaatctctagscaatgatgagtgtttctgaaattcagattcaccagaaagaaattgaaagcaaagagaagacagtgttgtcaaattatcatataattcagctaaaaaaaaaatcatggtacttaagtgggagctagagcacatcactgcctttaagaagatatttaggggaataaaagagktctgggacctcggaggtgaaactgagagaaagacaaagggacttcaaatcaagcatttgaaagagccaatgaggggccagatgtggtgactcactcctgtaatcccagcactttaagacgccaaggcgggatcccatctcaaaaaaaaaaaaaa

SEQ ID NO: 1712 - DNA, 1259 bp, Homo sapiens
tttttttttttttttttttttttaaagttataaaaatattttatttaaatgatacagaaaaaaatgtatacttaaaagtgattaaaacttcacattaggaaatgctaaaaacccagtaatgtacataatgataaaatctaaagtgatgagaaaacataaaatattttcatttggtcctgtcacctaacaaaactatcataaatatgagattatagtaattactaaagctggttaaaggcacatgacaacataattcctttatacacatccagtcattttatacaaggaactgctatcccttaaatggaagagtgaactacttgtttaaaatattaacagtgcactatgtacctacaatgaaaccactttctccaaagactcaaacagattaacattgcaaaatagtacttctgtatcactgacttctgaaaattttaataatttatgcatatgcaagtgaaatataatttattctggtttcaaccaacagttatacaaagtcacaattttccccaggaaaccattcacttcatagctgcaaaaacacactgtagcttttctgttagggtctgccatgctttcagctagctggatgtttaaccattcacttcaaatttacatgtccagccaggcacggtggcgtgggcctgtagtcccaactacttcgaaggctgaggcaggaggatcacttgatcccaggagttcaaagacagcctgggcaacatagaagaccctgtctcttcggaaatcatccaaggagtgtgataaacatgacaacccccataaactgggtaaacaacaacaatggagtgaaaaacgaccacacatgccataaagcaatgttgaagcaaattcctgctgcaataaaggaggcagtggtaatgggtatcaaggctggatacttgacatcatattctccaattccacaataccattccaggtagactatgcagtaaaatgcaattgataaactgacaagcaacaaggcactgccacagagaaaccagctgctagtgtggaagttttctttaagggttttaaagaagtcaacataataggtcacaacaatggatgccaaaatccagaatccagaatggatattaagtcttggaagaggtttctcctttttctcaacagctgtggaggtttccggcccggcgtcaccctcgcggtccagctgggcctcggcgtccggcaggaggaggaatcgccgccggagctgctgccgggcccgcgaggagtccatcttggctcgtgcc

SEQ ID NO: 1713 - DNA, 1905 bp, Homo sapiens
  misc_feature (846)..(846): n equals a,t,g, or c
ggcacgagaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacattccaatgcttcagaagtagcttcagsacagaagattgctgtaccagcaacatcacatcatttttgcttttcaatagacttaaggagtatacatgccttggagattggttttccaatcaactgtatattaaggtactcatatccattctttggaagtgcagctcctattatgactaatccycctgtagaagttcggaaaaacatggaagtttttcttccccagtcttactgtgcatttgattttgcaactatgcctcatcagstgcaagmcmccttcttaaggattccattactggttgaactatggcmcaaggatwaaatgagtaaagatttacttctgggaattgcgagaatccagctttctamcwtcttgtcttcagaaaaaactcgttttttaggttctaatggtgancagtgttggcgtcaaacttacagtgaaagtgtgcctgttatagcagcacaaggatcaaatamcaggatagcagatctttcttacacagtgactgtagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagrggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacaggcagccaaggcaaaataaagattatactcacttgattgaggagcctttaacccagagcacctggcactggagaggacttctttcactaccctctaacttgtgtgtgtgtgtgtgattattattaatgccctatacttgattaaaaattcaaagcatttaaaggaaaaaaaaaaaaaaaaaaaactcgag

SEQ ID NO: 1714 - DNA, 1147 bp, Homo sapiens
ggacacgaggtggccgtcggttccgagtccatgcctgttttctccgccaccggggacctatgcaagggccagggctgggccactgccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctcycattgctggaatgatttaagcagaagtccttttgkgtacttttaaaattgkatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaaaaaaaaaaaaactcgag

SEQ ID NO: 1715 - DNA, 998 bp, Homo sapiens
  misc_feature (358)..(358): n equals a,t,g, or c
  misc_feature (481)..(481): n equals a,t,g, or c
aattcggcagaggaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggattctctcctccagtgcgtacgcagatcttctgaaaaggaatctgacaaatttagttgctgcatttttctaaattgctttcaagactacccagcacttcagatacttttcatggccctttttcccaaagtgttctccaggatgcctttgatctgcacgggcaatcccattagcagtgganggcttaagttcccacagaaactctgccacagaggcactgacaccagaccaggcgtgatccctaacagcttgctgtaccgactcatatgagggctgtcttggtccgtctcatttaaggtttggncttctccaaagwttagacaccytgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaaaaaactcga

SEQ ID NO: 1716 - DNA, 810 bp, Homo sapiens
ggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggaaaaaccatatggcatagttgaaaagaagtccagaatattccctgtaagtcttaacacttctgattttycttttgtttattgtttttctctttccttttcctccctttccaagcaattattagattaaaatgttctttccttctcactttcggtttaagtccctgttttgtgtattcttgtaaaaaacaaaacaaaacaaaaaaaaacaggaagaaataccgtgaggtaacaattacagttcaaatgggaagtgagcacatttattttcaacctggctgtaaaacgtgttttgtgaccttgattttcctaaagggagttgaaagtaccaaaagtttttcactgtgtcctgtttcatgttgggtaaagagcttagggcatgagcctaagcaaacatccatgcatggtgacagcaactgaatttctgttattaattccaaactctcatgtcctatggctttgtacctcattttcaagatttgaccttaagttctccatctgtgaatttaatatccactaatgggtgttt

SEQ ID NO: 1717 - DNA, 436 bp, Homo sapiens
ggcacaggccgggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctctgtgccccctctcttatgtctctcacgctgtctcttgtccttgtttttaactctgacacgccgtgggaacttggctcacttcctagggggaagctgtctggactggcccagagatgggcaccaccatttcccaataaacacaagataaaatcaaaaaaaaaaaaaaaaaaaaaaaaaaaaaaaaaaaaaaaa

SEQ ID NO: 1718 - DNA, 3714 bp, Homo sapiens
  misc_feature (2324)..(2324): n equals a,t,g, or c
tgacttcacctgaacaagtagccgactcagtgaaacgtttcagagtgcattttrsccaaatggcattttagcagaggctgttccatgcagagataaaagtattcgaatgagaacaagagtagcaggaaaaacgaaatyacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggargaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctancagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtgtaaaatatttaaccataagtcaagtacagtgtactatgtttaataaagttacatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttwaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttargagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaacaaaaaaaaamaaaaaaaaaaaactcgag

SEQ ID NO: 1719 - DNA, 1263 bp, Homo sapiens
  misc_feature (184)..(184): n equals a,t,g, or c
  misc_feature (1254)..(1255): n equals a,t,g, or c
  misc_feature (1261)..(1262): n equals a,t,g, or c
tggttactgagatggtgaaaaccaggggagacctgggggacatcacaagcttggttcctaccaggtttatggagccgtacatctttgggagccgcctggaccacgacatcatcgacctggaacagacagccacgcacctccagctggccttgaacttcaccgcccacatggcctaccgcaaggncatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccragctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatgaaaaaaaaaaaaaaaaaaaaaaaaaaaaaaaaaaaaaaaaaaaaaaaaaaaaaaggggggnncccccnna

SEQ ID NO: 1720 - DNA, 1476 bp, Homo sapiens
ggcacgagccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaaaaaaaaaaaaaaaaaaaaaaaaaaaaaaaaa

SEQ ID NO: 1721 - DNA, 475 bp, Homo sapiens
ggcacgagcttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaaaaaaaaaaaaaaaaaa

SEQ ID NO: 1722 - DNA, 2708 bp, Homo sapiens
  misc_feature (1953)..(1953): n equals a,t,g, or c
agcctctttggctcaaaagggtgkgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtccccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttargttctgtaagtggaaaaatgtgcttttattttatgggccatttttaccacaactaatcttgccttggattactaagcatctcctgcgatcccacagaggactgtggtggccacaggagctraagcagaagagtgggatttratgccaggcagtggagtggcctcagccccagattgtacctcctgccctgtaggaggggagggggcaaagcnttctgaacttcacctttgtttgacctatgtatggaacttacttttactttttgccttaaatttttaatgaaagcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagccactgcacccagcttttgctggaagtttgattagcttgggttgaatctgtagaacaagttaagaagaactgacatcttgacaatatgaagtcttcctattcatgaaaatggaatatcttttcatttatgtagttcttctttgataacatcagacttttcctcttgtaaatcttgtaggtatttcattcatttatacccatttcattttgagggggactaatgtaaatggtaattttgtttgtttgtttgtttttgaaacggagttcactcttgtcgccactgcactccagcctgggtgacagaggaagctccgtctcacaaaaaaaaaaaaaaaaaaaaaactcgag

SEQ ID NO: 1723 - DNA, 1314 bp, Homo sapiens
tcgacccacgcgtccgggtaattgtttgaaatctaaaatgtcaactttctatattttcatttttatgaacaacactgttcgtaaaggcagtaatgcttcgtgtaattactggtacataaaagtctgattttgaaagtcactgtaaactaagcctgttttctgcctttctttctagtaacaacccttcagcagcgtctgttacagcctgacttccagccagtctgtgcttcacagctctatcctcgccacaaacatcttctgatcaaacggtccctgcgctgccgtgtaagtattccattctgtagactgaccatttgtacaagaggaaagcaaaaataaatgtggctggtgtctgactaatgtcaaaacctttggaatgtattaaatacagaaaatacttgtagagaacatactaattgccaggcactattttaaatgctttcaatataaacagctcttacaactctgtgaggtaggtactactgttaaacctgttttacaaatgtagaaaatgaagtatctgaaggttaagtacatagggttaacccctaaaagaatagtgaaagagtgtgaacttttaggctagtgttcaggctcagggaggaccaataaaaaataatcaatttaaaagaaagcaagaaaaatcagcaaaatccaggctctggtaatctacagaacaaatgacagagtttcttcaataaataaattgtaaaaacaaaatggaaaagaaaccttttagaggagtactatccaacagaactttctatgggtgatggaagtatyctgtgtctgtacagtccccgcatgatagccactaggcacatgtggctcttgagcacatgaaatgtgatagtgcagctgaggtactgagtcagtctttaatttcatttaaataaccacatgtcgctagtggctaatgttacttaatcattctctagattagaagagacttaaagtttaccaaacacaatgtatagagtttacgtagattcggattcaaacaaaacagaaagaaagggcccaggggaggagggaagaagggaaagaggaaagaaggaaagaaaaatttgtgaaatctttgagaaaatttaaacactggtagcattttcgatgctattaaaaaactattgggcagggcacagtgacatgcacttgtagtcccagctactctggaggctgaggcaggagaatcccttgagcctgaggagtttgagactgtagtgtgtgatgatggtgcctgtgaatagccactgcactccagcctaggcaacacagaaagaccctgtctcttaaaaaaaaaaaaaaagggcggcc

SEQ ID NO: 1724 - DNA, 1022 bp, Homo sapiens
ccacgcgtccgggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttaaaaaaaaaaaaaaaaaaaaaaaaaaaaaaaaa

SEQ ID NO: 1725 - DNA, 2820 bp, Homo sapiens
  misc_feature (68)..(68): n equals a,t,g, or c
  misc_feature (2818)..(2818): n equals a,t,g, or c
  misc_feature (2820)..(2820): n equals a,t,g, or c
aattcggcacgagccgcggtctccggaggctttatctgcagtgctgcctgcccgctgggtggtactgntacctagtgggtyttggggaccttcgaaatcgccgccgctctcacaatggcttgggtccagactgcgccacagcctctcgggagacgtgggccctcggaacctttttagtgccggactccgggccgcagagattcccgcggcagcaggtatcacaggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttggaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacrgaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaaaaaaaaaaaaaaaaaaaaaaaaaaaaaaaaaaaaaaaaaaaaaaaaaaaaaaaaaaaaaaaaaaaaaaaaaaaaaaaancn

SEQ ID NO: 1726 - DNA, 787 bp, Homo sapiens
ccacgcgtccgcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcattgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctgtttgtgatcttcctgattccacctacaagttcattagttctaaataaaagcctgttggcaagtgaaaaaaaaaaaaaaaaaaaaaaaaaaaaaaaaaaaaaaaaaaaaaaaaaaaaaaaaaaaaaaaaaaaaaaaa

SEQ ID NO: 1727 - DNA, 2638 bp, Homo sapiens
cccacgcgtccggaggtctacagtatttgtgttggcatagtttttgtaaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgttwctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggrcaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagacccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggraaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaaaaaaaaaaaaa

SEQ ID NO: 1728 - DNA, 787 bp, Homo sapiens
  misc_feature (4)..(4): n equals a,t,g, or c
  misc_feature (11)..(11): n equals a,t,g, or c
  misc_feature (13)..(13): n equals a,t,g, or c
agangggaaancntggtactccgtgcaggtaccggtccggaattcccgggtcgacccacgcgtcmgacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccagccatgtggcctgcccagcctcaatgtcacttggyggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaaaaaaaaaaaaaaaaaaaaaaaaat

SEQ ID NO: 1729 - DNA, 799 bp, Homo sapiens
  misc_feature (4)..(4): n equals a,t,g, or c
  misc_feature (11)..(11): n equals a,t,g, or c
  misc_feature (13)..(13): n equals a,t,g, or c
  misc_feature (779)..(779): n equals a,t,g, or c
  misc_feature (793)..(793): n equals a,t,g, or c
agangggaaancntggtactccgtgcaggtaccggtccggaattcccgggtcgacccacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggyggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaaaaggggnggccgttttaaagnatccaa

SEQ ID NO: 1730 - DNA, 1726 bp, Homo sapiens
  misc_feature (1695)..(1695): n equals a,t,g, or c
  misc_feature (1707)..(1707): n equals a,t,g, or c
  misc_feature (1710)..(1710): n equals a,t,g, or c
  misc_feature (1724)..(1724): n equals a,t,g, or c
gtcatggcggcggccgccccaatgccggaggtckgcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctragggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaatccgtttacaaaaaaaaaaaaaaaaaaaaccngggggggggccnggnaccaaattcccccnaa

SEQ ID NO: 1731 - DNA, 936 bp, Homo sapiens
  misc_feature (168)..(168): n equals a,t,g, or c
gaaataatgtcatgcataatacattcttcaacactatactaattactaagcacctaatatattgttattttgtttgttttttaaactgcatattttgtcagtgtggcatctcttgtctgtgaaatattcctttaacacatgtggtgtattttctcacctacgtatgtntcctcttcctaagtagtttaaaacacacacacgcgcgcgcgcgctgtgcacatgcttattcattgactaagttatccatgaacctgtcatttctgtcttctggagcaacatggaatctcatatttctatcttaatcacatatgtttaattttgcctttgttttgtggtctgtgggtacatttgttatttttagtatcaagtcatttggctaaatcatattaaattgcaatcacctaaaatcccctggttattttgacttaaatgactgtcatctttggtttcccttacttagaacgtcacacagttaattttttttttcaacctaatggcaagtgtgtgtgtgtgttcttggagtagttctgctggctatgaagagtatgtagtaatatgctaaagctttgtaaactcttcttttgttgttttggaagatggagtgttgctctgttgcccaggctggagtgcagtgatgtgattttggctcactagagtctccaccttctgggctcaagcagtcctctcacctcagcctccctggtttgtggaactacaggggcatgccagcatgcccggataatttttgtattttttttcttttgtagatacagagtctcactatgttgcccaggctagtctcaaactcctgagctcaagcagtcctcctgcctcagcttcctgaagtgttgggattacaggcatgagccattgcacctggccctaaattttaacagatacaaaactataagtttatacttaaaaaaaaaaaaaaaa

SEQ ID NO: 1732 - DNA, 698 bp, Homo sapiens
gcttctttaagattcgtctctgggaagagatttacccagtagagatcagagccggacattttattgttttccaagtttgaccttttcatttcaggagcatcaagcatgaagagccaatccagtttaagtgtgggcatcttgagagtaacactgtgtcttgttccttcttgtgttcctgctattgactgcaatgctcagtaaatgtttcaggcatccacgaatgaatgattgaacaaatcaacaattaatcaattaataaatgaaagctatcatcatcaggtggaaataatgcttttaagtaagactaagggcttttatcactacagagcataatagaaaggaaacaagccaattaataagaaataattttgcttaaaaaataatttttcaggcctggctcggtggcctcacatctgtaattccagcactttgggaggccaaggcaggaggatcacttgagcccaggagtctgagaccaccctgggcaacatggtgaaaccctatctctacmaaaaatwcaaaaaattagccgggtgtkgtggtgcgtgcctgtagtcccagctactcaggaggctgaggtgagaggatcacttgagcccgggaggtcgaggctgcaatgagccatagtcgccaccgcattccagcctgggtgacagagtgagaccttgcctcgaaaaaaaaaaaaaaagggcggccgc

SEQ ID NO: 1733 - DNA, 903 bp, Homo sapiens
ccgggtcgacccacgcgtccgctgcatccaaggaactagcttctaaaaaatccctgcctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1734 - DNA, 1971 bp, Homo sapiens
  misc_feature (4)..(4): n equals a,t,g, or c
  misc_feature (1270)..(1270): n equals a,t,g, or c
taanccaagattgcatcattgcaatgccagcctgggaacagagcaagaccctgtctcaagggaggaaaaaataaaaaaataaataaaaatttaaaaaaagaacacttgaagttactcagatcaggactcatgcagagaaaagccaacaggagcaacaccccacattaggggaggaagacacctggggattcactgacttcagttgtgtgaattttaccctatgaccttgcttgctttatgagacagcagaggtggccaaggtcaatcctactgctctgtggtgaactctgcttttctctcgttaccataggtaaagggtcatgctcctatgtaagccttcctgttccccagtcatttgtgcacggggtaggccatcatctcctgcctattcaagggaatgactagtcctgtcttctgtatcctcagtcaccaacttctcagttagtgttgaaccaagcctatgttcaaaacatgactgagacagacctcaatccatagagatttatttagccaaggtccaaggacacatctaggaaaaaatacgggatcacaggagcatctgcgccttctamtttttccaaagagggttttgggaacttcagtatttaaaggggaaacagcaagcaggtgaggaaaaaaagcgaggaagtgtaggcagtgacagatgctcacattcttgtgaaactctgtttaccctagtaaatctgcattttacatgtgaaaagagggagtaaaggaaatagtcaataatgcattcctctcaggataggcccacgtggatttttaatcttgtccttgccctgtgaagataagctggtaactgacattgtcagggtgagattcagcagaactcagttttaggactaacttacagaggagctgtgtatcctgaagattcagcgactggcaaggaatttccttgggagcaatgtgtgagggaggccatctgaggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagkctattttctttcacacccatcagcactgttaagtaagcaggaagacaacctgaggttggctctttactttgagktcctacataataaattgcagcctaatttagtacataaacccaaacctaatttaggagtaaattttttgtagcagatagncagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttggtcacataaaattggttaaatttaacttctctaaagttttgtattaaattgtatgtaaaacattggtagcacaatttggattcagatacccaaatattgactatgataatgtaaataatccttaagcagactgatttacaaaggcctgaacaagtttgatattctgaatattcacttcttctgatgaaaaaattgccaagaccttacaattggcaggaaaaaaatgtgtgttggttaaataagttatgttaacaacaagaacattaccacaattagaaaactcttactatgccaggcactattataaacacacctttgtaccttttttaatcctgaaaaatttctaataaatatgcatttaatattatttgtatttaatattaagtgtatttaatattgcccctgttttgtgaattaatgcagcaataaactggcttgcaatggaaaaaaaaaaaaaaaagggcgsccgc

SEQ ID NO: 1735 - DNA, 1086 bp, Homo sapiens
ccacgcgtccgcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgtgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgttcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctcatgatttgggaaccagcttaggcaaaagagtccccacaagatgaaaataaagatcctagttaccattcaaaaaaaaaaaaaaa

SEQ ID NO: 1736 - DNA, 559 bp, Homo sapiens
ggcgagaagacgacagaagggatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaactaactaatactaacatctcagacgctcaggaaatagaaaccgtctgaactatcctacccgccatcatcctagtcctcatcgccctcccatccctacgcatcctttacataacagacgmggtcaacgatycctcccttaccatcaaatcaattggccaccaatggtactgaacctacgagtacaccgactaaggcggactagtcttcaacttcctacatacttcccccattaatttcctagaaccaggcgactgcgactccttgacgttgacaatcgagtagtactcccggattgaagcccccattcgtataataatt

SEQ ID NO: 1737 - DNA, 1425 bp, Homo sapiens
gacggtgtgtcagaggtcaggtgaatatcgcagatgaggcaaaactttgtagcccaattcgttcaacttttgaagtgttggttgtgcgatgtgtggtcaggtgttgtcgtggagaagaattgggccccttctgttgaccaatgccagctgcaggtattgcagttttaggtgcatctcatcgatctgctgaacatacatctcagatgtaatggtttcgccaggattcagaaagctgtagtggagcagacctgcagcaaaccaccaaacactgaccataactctttttgggtgcaaatttggctttcggaagtgctttggagcttctcgatccaaccactgagctggtggtcgcccgttgtcacggttgtcatataaaatccacttttcattgcacgtcaaaatccgattgagaaatgcttcatcattgttcgatagaataaaagaaamcatttcaaaatgacttttttgatttttggtcagctcatgaggcacccacttatcgagctttttcacctttccaatttgcttgaaatgccaaacaaccatagaatggtcgatgttgagttcttgggcaacttctcgcatagttgtaagaggatcagcttcaatgattgctcacaattggttattgtcaacttctgatggccgacaactgtgcttctcatcttcaaagttcccatcccctttgtaaagcttcttgaaccaccactgccctgtacattcattagcagttcctgggaaaatgcattgttgttgttgcgaattgtctctgctgctttacgacccattttgaactcaaataagaaaatcgctcaaattycctttttgtctggcatcatttcaaaagtgtaaaataaatgtaaaataaacagcaagtaagaagtcattagcaaaaaagaataaagtgagaaacacacattgaaatgatgtataacataaccacatttatttaagaatgtattacaatatcaaatgacaaatttcaacaatgcaaaaacctcaattgcttttgcaccaacctaatatatgtatccctcaaacaactaactatacttagcatctctcaatgtgctcactgcccatttttatatcttccttgaagaagtctctctttaaatgtgttttttaaaggaattttcttgttaatattgaattacagttataggaatttttatatcttcaagatataagtgctttattagaaatatgacttgcaagtaatttctcccagtctatagtttatgttttcatgttcttaccagtaaaatattaattctttgtcatacaaacataaacaaattttattaatctagcaagtagaagtaacttggaagtcatacttgcaatattaaggagaacttactgtttcaacctagtccttcaagaactaaaatgtaaaaaaaaaaaaaaaaaatgatcctcgag

SEQ ID NO: 1738 - DNA, 2324 bp, Homo sapiens
ggcacgaggccaggccacttggaaaaactatggaattctttttgaatgagtctgcttgtaatgtcactctgctacttccttggtgagctatttgaactctctgcctttaacctcccctttgttcatagggctcgtcctccagtcactactgtagaggcaggaggggagctcttatatccatagctgcttgattccccctgtattttgtctttctgttaacgcacataagcacatcatagactacataacagcagtgtgaggagttcaatacatgcatgtagacatacatctcaaccaaacttagtgtcagaaaaagcaacttcaaaattcataattcagtgaaaagaagaagaacatggttggtccaaatgccacgacaagctcaacaatcacaccaggaatagaacctcataaaactcttgtgctaagaagcagttttgtgataatcaaagcatctctcttttcactcaggtctaggtactgaggttaagttagttatacaaggtcacaccaataattaggagtatacctaggagccaaactcaagtcttgtttacatttgtacatttcacaaaactttataaattctccatcattaaatatgtcctggattatctaatctacacacacactgtccagtaagaaagaattttctgcagaaagtctcaacttccagtgagcccactaatctctaaaagacatgtcttacttgatttaatgttaatttctccccacaatgcattctcttcctctttccacgcagttctattttgatggatcctgataagccttgtacctaggaaattcttccaggctagtttttccactacaggcgctggcgtttcccactgaccatcatcatagccggtgcataatgagcccaccaagctcttgaatatgtccagagccaaatgcagaagagaaaggactgacctgggccactgttcagtgttttactgtaacacaaaacaatagaaagtgctcttttattcactcaagtcctaaaggtgctgtactctggattaaagaggtagcttggggcaaacagaaaccccaaaagactcatgtttttctttggccttaggaagctcagacctgactttgtaggccaagtttggttatggtatgaggactttacacttaagcttttatcttaatcctcaattgcctaacataattacttttgtcttatacatatttctgtaagtcattgtttatttttcttgaagaacaaggtaaattactttcaccattttttttttattttgaaatagtcacccaaagttttcaagatatttaccagaggaaagttttagtgtgccctttacccagtttcactaaatggttacattttacataaataatcaaaatcaagaaattgacactggtgcaatatgtatatgtgtagttctaggtcatgttctcacatatgtagattcctgtaaccctggagcaccctgaatcaagatacacaactattccatccccacaaagatctttcctgctatctcttcatatcgtacccactcccttcaccccccgtgtattagtccattctcagaccactataaagaaatacccaggactgggtaatttttaaaggaaagagggctaattgacttacagttctgcatggctggggaagcctcaggaaacttataatcatggcggaaggaaaagcaggcgtgtcttacgtggccagctggtaagagagagagtgtgtaagagcaaggaaaactgctttataaaacccatcagatctcatgagaactcactcactatcatgagaacagcatggagaaactgcccccataattcaatcacttccctccctccacacatgaggattacaattcaagatgagatttgggtggggacacagacccagactacatcacctggcacccaccaacctgttctccattgccataattttgtcattttgagaatgcatataaatcagttcatgtagtatgtgaaggtaaatatatttttgaagtacatttattttttcactcatctttttttctctagatcattttcatttaccattttattaacatatccacttattcaagcagaagacttggctgggaaagccaccactggagagattcaaaatgttctaagaccactcttacttcactgtagcatataatttggtttagtaacttacacgtaaaaattttatagatgataggacagataactatatctttattctctgtggcagattcgataatggcttcccaaagatgttatccatgccttaatcccttgaacttgtgaatgtcaccctgtatggcaaaaaaaaaaaaaaaaaa

SEQ ID NO: 1739 - DNA, 2041 bp, Homo sapiens
  misc_feature (2017)..(2017): n equals a,t,g, or c
gggtgaggggaaaggtatgtgtttgcatcttctgttagcgatttctgggattctgaatcttcactgtcacttagttctgtgcagttgtgggagatatacccagaagacacaggcaaatacaacctgggtaactagctaggggtttgttcccaagtccctatcttatatgtcctggcgagctgccctaaactacgtgtgaggaataaagactgtgttctttcagctcagacctgtgattcttgagtgttttaagagtcttttaaaatctatgaaccctctttccagcaagtcgtaaatgtacagaatagttttgtgtaggttttcagggaattcatgaataccactaaagctgttccagtagactgtattgggagtcttataggataattactggcaggcttgggcaacctcttggccccattcccttagctgtgtgtcttgatkytagccctgtgaaagagtccttcactcttaagatttagagcccagatgacctttgccagccgtttaccttttttcctggggtgtcttgttgatcctgctgggtttctatgggtacaagaccctcttaaacatgaagcagctctatatttgtcgttttaaaatttattttattatttttaacaaattggccagagaccgcctttttaaaaattttctttcctttccttttcttcctttcccttctgtttccttcccttccccttttctttttcttcctttttttccttttctttcctttttcctttccttccttcctttcttgcctttcttcctttattgctttcctttcttttctttctttcacccaggctggagtgcagcmcactgtaacctcaagttcctgggcttccaagwagtgggactataggccacaccaccatggccccataatcttttttctttttttacttttttttttttttagagacgggggtctcattatgttgcccaaggatgatctcagactcctgggctcaagcagtcttcccaccttgatctcccaaagtgctgggattatagatgtgagccaccatgcccaatctttgtttttttaattggcaagtaaaaattgtgaagacttatggtgtacaacatgctgtgttgataatgtgtatacattttgtaatggttaaatcaagctctttaacatgtgtatcacctcacatacttatttttttgtggtgagaacacttgaaatctactctcagcaattttaaagtatataatatgttgttactaactgtagtcacatcactatgatgtgcaatcgatctcttgaacttactcctatctacctgacattttgcatgctttacatctccccagtctcccaacccccagcttctgagaaccaccattctacttyckgcttcwatgagtccaattttgtttgctttagaggtggtacctcactctgtcacccaggctagagtgcagtggcacaatcatggctccctgcaatctctaactcctgggctmaagtgatcctcccgcctcagtctcccaagtagctgagaccataggcgtcsgcmaccacgcccccagctaagktttaaattttttgtagagataaggtcttaycakgtgcccaggctggcctcaacctccaaagtgctgggawtgcagttgtgagccactgcactaagcctgagtcgacttttttggatccacacttaagtgagatcatgcagtatttgtctttgtatgcctggcttatttcatttaagataatattttccaggtttatctgtgttgtcttaaatgacaagatttattttgttgttgttaaggctgaatagattctgttgtatatatatgctacattatctttatctcctcatctgttgatggatacttaggttgattccctatcttggctattgtgaatagtcttgcaataatcatgagagttcagatatctcttcaacatattgacttcattttttggggatatatacctagtagttggttttatatccatctcattaataactacatgaaagacaaaaagagnaaagaagaataatccagctatcta

SEQ ID NO: 1740 - DNA, 2054 bp, Homo sapiens
gggtgaggggaaaggtatgtgtttgcatcttctgttagcgatttctgggattctgaatcttcactgtcacttagttctgtgcagttgtgggagatatacccagaagacacaggcaaatacaacctgggtaactagctaggggtttgttcccaagtccctatcttatatgtcctggcgagctgccctaaactacgtgtgaggaataaagactgtgttctttcagctcagacctgtgattcttgagtgttttaagagtcttttaaaatctatgaaccctctttccagcaagtcgtaaatgtacagaatagttttgtgtaggttttcagggaattcatgaataccactaaagctgttccagtagactgtattgggagtcttataggataattactggcaggcttgggcaacctcttggccccattcccttagctgtgtgtcttgatkytagccctgtgaaagagtccttcactcttaagatttagagcccagatgacctttgccagccgtttaccttttttcctggggtgtcttgttgatcctgctgggtttctatgggtacaagaccctcttaaacatgaagcagctctatatttgtcgttttaaaatttattttattatttttaacaaattggccagagaccgcctttttaaaaattttctttcctttccttttcttcctttcccttctgtttccttcccttccccttttctttttcttcctttttttccttttctttcctttttcctttccttccttcctttcttgcctttcttcctttattgctttcctttcttttctttctttcacccaggctggagtgcagcmcactgtaacctcaagttcctgggcttccaagwagtgggactataggccacaccaccatggccccataatcttttttctttttttacttttttttttttttagagacgggggtctcattatgttgcccaaggatgatctcagactcctgggctcaagcagtcttcccaccttgatctcccaaagtgctgggattatagatgtgagccaccatgcccaatctttgtttttttaattggcaagtaaaaattgtgaagacttatggtgtacaacatgctgtgttgataatgtgtatacattttgtaatggttaaatcaagctctttaacatgtgtatcacctcacatacttatttttttgtggtgagaacacttgaaatctactctcagcaattttaaagtatataatatgttgttactaactgtagtcacatcactatgatgtgcaatcgatctcttgaacttactcctatctacctgacattttgcatgctttacatctccccagtctcccaacccccagcttctgagaaccaccattctacttyckgcttcwatgagtccaattttgtttgctttagaggtggtacctcactctgtcacccaggctagagtgcagtggcacaatcatggctccctgcaatctctaactcctgggctmaagtgatcctcccgcctcagtctcccaagtagctgagaccataggcgtcsgcmaccacgcccccagctaagktttaaattttttgtagagataaggtcttaycakgtgcccaggctggcctcaacctccaaagtgctgggawtgcagttgtgagccactgcactaagcctgagtcgacttttttggattccacacttaagtgagatcatgcagtatttgtctttgtatgcctggcttatttcatttaagataatattttccaggtttatctgtgttgtcttaaatgacaagatttattttgttgttgttaaggctgaatagattctgttgtatatatatgctacattatctttatctcctcatctgttgatggatacttaggttgattccctatcttggctattgtgaatagtcttgcaataatcatgagagttcagatatctcttcaacatattgacttcattttttggggatatatacctagtagttggttttatatccatctcattaataactacatgaaagacaaaaagagaaaagaagaataatccagctatctaaagtcacgaaaa

SEQ ID NO: 1741 - DNA, 4038 bp, Homo sapiens
  misc_feature (1764)..(1764): n equals a,t,g, or c
  misc_feature (4030)..(4030): n equals a,t,g, or c
  misc_feature (4037)..(4037): n equals a,t,g, or c
caggaactkgcgctkaagaccctgggracagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgsccgacttccccttttggttctcccctgctcagttcaccggcsacatcatcctctccaaagacgccacccacgtccgcracttccggctcttcgtgcccaaccacaggtctctgaatgtggacatggagtggctttacggggccagtgaaagcagcaacatggaggtggacatcggctacataccccaratggagctggaggccacgggcccctctgtgccctccgtgatcctggatgaggatggcagcatgatcgacagccacctgccctcaggggagcccctgcagtttgtgtttgaggagatcaagtgggcagcaggagctgagctgggaggaggctgcccggcgcytggaggtggccatgtacccyttcaagaagtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagcactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggccccccnagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaaaaaaaaaaaaaaaaaaaaaaaaaaaaaaaaaaaaanaaaaaana

SEQ ID NO: 1742 - DNA, 1674 bp, Homo sapiens
  misc_feature (5)..(5): n equals a,t,g, or c
  misc_feature (8)..(8): n equals a,t,g, or c
  misc_feature (474)..(474): n equals a,t,g, or c
  misc_feature (505)..(505): n equals a,t,g, or c
  misc_feature (511)..(511): n equals a,t,g, or c
  misc_feature (606)..(606): n equals a,t,g, or c
ggcanagnatgacctttggtgaatatgtggcactaattttttttaccttaatcatattcttgtcaagtaggcaacccattgccccttggagaccacaccagccctgtaagttctcaccagcagcatggagattaggaagaggggctgctgtgaccaggagatacacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctaaagttgctccatttaatgcatgctagcaacagccttaactttggatncagttatttgaaacactttcccggcatcttncccttnctaatgttgtggggtggaaaccggatggcaaatcactgtgagccggatacctcagcacagtccaccttgtgtgtgacttcacaaatgggggactncacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacagaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcaaaaaaaaaaaaaaaaaaa

SEQ ID NO: 1743 - DNA, 878 bp, Homo sapiens
  misc_feature (5)..(5): n equals a,t,g, or c
  misc_feature (17)..(17): n equals a,t,g, or c
  misc_feature (28)..(28): n equals a,t,g, or c
  misc_feature (49)..(49): n equals a,t,g, or c
  misc_feature (60)..(60): n equals a,t,g, or c
  misc_feature (877)..(877): n equals a,t,g, or c
tcacncgggaaccgctntgaccatgatncgccargctsgaaattacccntcactaagggnacaaaagctggagctccaccgcggtggcggccgctctagaactagtgawcccccgggctgcaggaatycggcacgagctggcacacaccaccatgcacagttccttgttcaaaatgccaagaacctggatgactcatagtcaagaccctccaccagtaacatatattggcgagccagccaggagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcgggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaagagcactcataaattaaataaaaaaaaaaaaaaaaaaactccgggggggggcccggtaacccattccgccctaatagng

SEQ ID NO: 1744 - DNA, 1134 bp, Homo sapiens
ggcacgaggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagccccgtctaaggaagctgtccttcctgcctaccccacgtactcagggttctgaagatgtggtacaggctttcatcagtgagattgggaattgagggcatcggacctgtccagtctgctggagcagtttgagaaatcagaaggtgagggaacatgggtagttttgctccaactctttttttggtgatacttttttgggcccagccctgtagttgcttaaactagggtgagaggggacagccttagccactggagcagacccctaattgaagagagagacaagattgaactgtgacggtaatccaagccagggacggcagtgatacagtaaggaaggtattaaagagtagactgggaatccaggccaggcgtggtggctcatgcctgtaatcccagcactctgggaagctgaggcgggtggatcatgaggtccaggagtttgagaccagcctggccaacatggtgaaaccccgtatctactaaaaatacaaaaattagctgggcgaggtggcgggcacctgtaatcccagttactcgggaggctgaggcaggagaattgtttgaacccagcaggcagagattgcagtgagccgagatcgtgccattgcactctagcctgggccacagggtgagactctgtctcaaaaaaaaaaaaaaaaaaaaaaaa

SEQ ID NO: 1745 - DNA, 1260 bp, Homo sapiens
agcagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggmaaaaaaaaaaaaaaaaaaactcgag

SEQ ID NO: 1746 - DNA, 1818 bp, Homo sapiens
  misc_feature (2)..(2): n equals a,t,g, or c
  misc_feature (16)..(16): n equals a,t,g, or c
gnaattcggcacgagnaaaagagtgattgtgagtgttagatatggcctttccctttcgtgcttctagccaccttgtcactgattttggaaacctcacttaacctctatgggtgggcctcaatttccatctaaaatagagaagtagggaggaattggatcaaaccagcccaagaaaatttaattaactatttcaaactctaatgaaaaatctctactttaaaaattgaaacacaaaaatgttctgggaggttctattcattgtctgctttcctacatttgccctgattacaagactgagttccttgataattgaaaccatgtctctttatctagtgccyagcatagtgccaagcacacagtgtatgcacagcctattggtatgaaagagaacacaacttcattaattctcatatctctccagttcacaccccttcatctcctgtaaaacaccccttcccctacaattatttctgttagtctctaggtgtttcttgtattcaagagtatgtccacagtttgggtgcctctgtgcattccttctatctgagcatctgccatcattggtgcctgccatgcactgctgggaacatttgacccctctgggagcatcttcctaatagatcccataaactgcaaagccttatggttaccaaaatgatggtgtatatatatacttggagccttgcaaagcccctaatgaaagtatttccttcaccagctagaagtactctcctttagcgatcagattaaaacacacacccaggtgtgtgttttaaagaaaaaggacccaagagggaaaaagtttccaaggcatgaatgaattaagagtggcaaatgctactgagatagaaagattaggacggagaaaacagcactcactctgacagtattctttccaactggatttggtaaataagagtgaagaggtacctckagtgagcactgggagaagtcatactggaagggataagcagtgattgacataagaaagtaaaataaattcaggttcatccagacacccccataatcttgccttgacccagaaacattgtgttcacaggactttcagcttcccacccccataagtaagcttcctaattatgatatcttggtcttgccaagcatttagagggccttactctgtggccctccagatagtgatttgaatgattaagtaaacctctttttagataagtgttctagtccagtctaacatcagcttgttggtctttttggcactgtcattgtccagtaccagcacattcttggctccttgccacatctctggcctcaatgtgggaggcaaagacagtgagcatttccagagtggtgagatgggtgcagcacataatgaggcgatgaccacacagcatctctgaacagcatgtccacacagggctcgaagtcattatgctgcatgtccacctcatgtccacaatagctgagcagttgagattggtggagtggaccttctcattactcatcatctarargaaggtcctcatcatctctacttctcaaaggggtagaattgaacctgaacctgcttgacagacaagagcccaagcctaaccaaggtggctgccatggtgacccttgccctgaaagccatttccattaatttaaaaattgtaggtatataggaactataataacaggcttaaaattaaaatttgctctgtttgttgggtcacacgtgtaatcccaatactttgggaggctaagccgggacgatcacttgagctcagaagtttgagactagcctgggcaacatagtgagatcccggtctctaccaaaaaaaaaaaaaaaaaactcga

SEQ ID NO: 1747 - DNA, 2154 bp, Homo sapiens
ggcacgagggcaggaatgtgggatcagcttagctggtggttctggctccaagttattcacacaaggctgcaatcaaggcgttgtctggggcttcggtctccgaagaccccaccggggctaaaggatccacttccaagctcactaatgtggctgttggcaggaggcgtcagttccttgctacatgcgcctctttgtattgctgctcatgacataacttccctggaaccagtgacccatgagagagagaaagcaaacccaagacagaagcagcagtctttgtataacctaaccacagaagtgacacgccatcacttctgccatatggttgttactggtcatacaagccaaccctggtacaatgtgggaggggcctatacaagggtataaataccgggagggagaatcattgaggactatcttagaggctgcctaccaaacaactcaagatattagcagcttaaacaagagaaaaatgtattttcctctaacgcagatatagtctatggaaacagtccaaagttgatatgatggttccatcttcatgtgagatccagacttcctccctcatctctttgccacttcatggtctaaggtggctactcaagctccagccatcacatctgcactccagccagtaggaagaaaaaagatctctttctttttacaaacacttcccagaacttgcacataccatgtctatttatattcccttggccagtaattcatcacaaggttacttccagcctgcaaaggaggctaaaaattttagtctttatttcacatgggttatgtgtccagaaagaattcagaggttctattactgagaagaaaggggggaaaatggaggtttggggataactagcaatctctgtttttgataacccaataaaggcaatgaactctttcacagaaaaaaaaaaaaaaaagaaatcatgtacatgcaaaagtgtgcatgcaacttcagagggtttacagatgcctgtgaagtcagtttatggatgtcacacaaagaacctctacacctctggccaggacctcagcctgttcctgtgtatgaacagtgttcacttagaccctttggacgaggtccctctgagagggcaaaggacacgcccagcacatttcctcaatggggcatgaaccacttcatctaatacctacgtggtaggctgtgtcaccccgggaagagtcgtcctggtgtctggcagattgtggacctcactttccttcagcgacttcatgcaaaacaagggctgataaggaagaaactgaaaggggttggtgtcacgggttatgctgcgggaccccccatttgtgttttcaagaatcagccaatagtgttcattggaattccagatcagcttttctctgctgacatttcaaatgccaggttacaagtacacaggcatggagccattctcaacactgttcaaattaaccatacttttcctagggctaaagataggtccaaggttaaaaccacaatgagataccactttacattgactagaacggctaaaataaaaaagaacaacaatgccaagtattaacgggagtgacaagcaagaggaactgtcgtctgttgctggaggtatgtaaaatagtccagccactttggaggacagtttgacagtttctttcaaagttatgcatgcacttaccataagacccacctatcccactcctgcaagagagaggaaagcatttgttcacaaaaagatttgaacatgagaccgggcgtggtggctcacacctgtaccagcactttgggaggctgaggcgggcagatcacctgaggtcaggagttcgagaccagcctggcctggtgaaatcctgtctctactaaaaatataggccgggcgcggtggctcactcctgcaaacccagtactttgggaggccgagacgggcagatcacgatgtcaggagatcgagaccatcctggctaacatggtgaaaccctgtctctactaaaaaatacaaaaaattagccgggcatggtgggtggcgcctgtagtcccagctactcgggaggctgaggcaggagaatggcgggaacccaggaggcggagcttgcagtgagccgagatcaccccactgcactccagcctgggcaacaaagcgagactccatctccaaaaaaaaaaaaaaaaaa

SEQ ID NO: 1748 - DNA, 947 bp, Homo sapiens
  misc_feature (423)..(423): n equals a,t,g, or c
gaattcggcacgagctttctagaggtaattactatgttcagattcctgggacctttccaggtatctgatgtataaatacctctctctctttccctctctttctaacacagatattagtattcctctgtgtcttactttatccccttaatagtatatcttggaaatcattgttttctttaaaaaaatgttttaattgaggtaagcattcattatacagtaaatgtcttgttccttttaactggctgcataccctgtcaacctatggctgtgccaacactggagagagtctgggttgagtatagtctttttgccattataaacagggttgcagtgaacattcatgtgtatacttctttgtacctatgtatgagtgtatcctggataaattcctaaaagtgacgccactggattggaggtcatttnttttttaaactttttattttgaaataattatagattcataagaagttgcaaaaacaggacagagaggccccagttgcccttcacctagtttctcccaatgatagcatcttacataacatgatacagcatggtatatcatatcaaaaccagcacattggtacaatctacaaaccttattcagatttcaccagttttacatgcccttgtgtgcatgtgtgtctgtgtctttgtggttttatgtgcttttatcaggagtagatttgtataacctcaaacaagatgcagaactgttctgtcagcacaaagatcccttgtgctacctcatagtcacaccaaacctcctctcctccttttgtcatcacggcattcctaactgttgacaagcagctaatctgttctccatctctgtaactttgttattttgagaatataattgaaatcgtatagcatgtaaccattgagatgggttttttcactcaccgtaattcccttgaagatcatccaagttgttgcatgtgtcaatg

SEQ ID NO: 1749 - DNA, 808 bp, Homo sapiens
agtccacgttctttaatagtggactcttgttccaaactggagcaacactcaaccctatctcggtcatattcttttgatttataagggattttgccgatttcggcctattggttaaaaaatgagctgatttaacaaaaatttaacgcgaattttagcaaaatattaacgcttacaatttgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgtgtttttttttttttttttttccaggacaaaaaataaaatatttattgatctatcacagcgagacacaaaaagatgggcggggcaggaatgggaactgctctgaagttcagtggaccgagggagggatggggggtatacagtactgcatgtggggacaccccgggtggggaggagatgcctggcaccccagtctgcacagccccgcacgccctgggggagtgtaggatgggggtggaggcagggcacaggcggccatgacaggtcaaccaggttgatggtgggtgcacccagccagctagtggtgccgggcggtcaactggggacatggatggacggaccgatggatgaatggacggatgggcggatggattctacaagggcaaggtggctattcccagtgtggggtggtttctcgtgcc

SEQ ID NO: 1750 - DNA, 839 bp, Homo sapiens
  misc_feature (834)..(834): n equals a,t,g, or c
aagaagacattaaggaaatgtctgaagaaatggataagaacaaaaacttgttttcccaagmttttmcagagaatggtgataatcgaratgttattraagatactttgggttgtcttttgggcaggttatccttgctagastcagtagtgaatcaacgatgtcatcagatgaaagaaagacttcagcaaatactaaatttccaggtaagtaagatattatcaaaggatacgtgaccattctctaggtattcagtaatagtcagtcacgagtctgtgttacagacctggttgttgtttttctaaatgcgtaatgaagaacaagagcattgtagaaaatgaagggggttgaattaaaggattagaagctaaagattttttgctcctagaaatggaaggttgagaaaaccacccacttcaaactaaggactgaatagaattcaatcaataaaagtcaaatttatggatcattataattataatttttagttactaataccggagtttaaacacattgagaaagaatatgcmgaaaatggccgggcacagtgctcacgcctgtgatcccagcactttgggaggccacggcaggcaaatcatttgaggtcgggagtttgagaccagcttggccaacataatgcaacccatctctactaaaaatmcaaagattagcagggtgtggtggtgcaggcctgtaatcccagctacttggaggctgaggcaggaggatcgcttgaacccgggacgcagaggtagcagtgaactgagattgcaccactgcactccagcctaggtgacagagcaagactccgtctcaaaaaaaaaaaaaaaaaaaaantcgag

SEQ ID NO: 1751 - DNA, 971 bp, Homo sapiens
ggcacgagctcatgtttcctagtatatatgaagtgacatgtataaatgacatgaatgctttcaggcaaaatgtttagattgtgatttgaaaatgatgtgcatatgagaagtcgttaagatgttggccaaaacagtgtgtgtataaattgagctccattgtttatgcattttgctttgcttcctcttgcattgacccatccactttttcaagttcacaatgattcttttttgctgctgccattgaaggatgccactgatacctgtgagagggcactctttggcatttgcattctgaaagttttgcattttcttatttgtgtttactttttaagttcatccttgttctgcatgacagatatgccagggcctgcaggaatagcattaaaattctgttgttttttagataactttattagtttaagttttaaatgataaggaccgagagctacaattcctctgttttttattctgaagctgaaccacacaaatattgaaaaacaatgctttgactggagtgttatatatatttccacctaactagcttcacacaataaaatctctaaagtttaaattgcttgaacctgagaggcggaggttgcagtgagccgagattgccccactgcactctagcctgggggatagagtgaaactctacctccaaaaaaaaagaaaagaaaaataactgaggaagacagttttcacagtgggtcaggtgagcctagaattattgaatatcgtcctttaacctatagctatgactctaggttaaagctcctcctcagcttgctccagtcaagagtatctatgtatttgagccatttcctgaaaccagactctagtgtttctgatcaggaccagctcagtctttaagtttctgaagtttgtttgctattttataattatattcgtgaatactgtgcattgaagaaataataaatctattgttgctttaaaaaaaaaaaaaaaaaaaa

SEQ ID NO: 1752 - DNA, 2351 bp, Homo sapiens
  misc_feature (72)..(72): n equals a,t,g, or c
  misc_feature (141)..(141): n equals a,t,g, or c
  misc_feature (294)..(294): n equals a,t,g, or c
  misc_feature (303)..(303): n equals a,t,g, or c
attctacagcagaatatacttggaaaaactcaagtttttccacatacttggaaaaactctctagcatttgtnggaatttagtgtaattaagtgaaacctacctagcaactgtagtaattaaaagcgtggggtgtgcttttngttgagatccgtgaatgtttctgtaaacacaattttgattgtgttgcgcttcttaaaggttgtgatgacaacggtaattttaaccacttgaccgtatatcgttttcatccttgaagactgtcatatatttccaagtgtctttcctccctggtnattttaggntaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggycttcctctgtggccagagcgttttcatcaccaagcctcctgatggcagtgccttcaccgacatgttcaagatactgacgtattcctgctgttcccagaagcgaagtggagagcgccagagtaatggatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcrgcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatmmaaaaaaaaaaaaaaaaaattggcggccgc

SEQ ID NO: 1753 - DNA, 2516 bp, Homo sapiens
  misc_feature (72)..(72): n equals a,t,g, or c
  misc_feature (141)..(141): n equals a,t,g, or c
  misc_feature (294)..(294): n equals a,t,g, or c
  misc_feature (303)..(303): n equals a,t,g, or c
attctacagcagaatatacttggaaaaactcaagtttttccacatacttggaaaaactctctagcatttgtnggaatttagtgtaattaagtgaaacctacctagcaactgtagtaattaaaagcgtggggtgtgcttttngttgagatccgtgaatgtttctgtaaacacaattttgattgtgttgcgcttcttaaaggttgtgatgacaacggtaattttaaccacttgaccgtatatcgttttcatccttgaagactgtcatatatttccaagtgtctttcctccctggtnattttaggntaaagatcgaggtccggaagccacctaggagattttttaattggttttattggagcattaacctgggagcgatcctgtcgttaggtggcattgcctatattcagcagaacgtcagctttgtcactggttatgcgatccccactgtctgcgtcggccttgcttttgtggycttcctctgtggccagagcgttttcatcaccaagcctcctgatggcagtgccttcaccgayatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcrgcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccaaaaaaaaaaaaaaaaaaaaaaaa

SEQ ID NO: 1754 - DNA, 2556 bp, Homo sapiens
  misc_feature (72)..(72): n equals a,t,g, or c
  misc_feature (141)..(141): n equals a,t,g, or c
  misc_feature (294)..(294): n equals a,t,g, or c
  misc_feature (303)..(303): n equals a,t,g, or c
attctacagcagaatatacttggaaaaactcaagtttttccacatacttggaaaaactctctagcatttgtnggaatttagtgtaattaagtgaaacctacctagcaactgtagtaattaaaagcgtggggtgtgcttttngttgagatccgtgaatgtttctgtaaacacaattttgattgtgttgcgcttcttaaaggttgtgatgacaacggtaattttaaccacttgaccgtatatcgttttcatccttgaagactgtcatatatttccaagtgtctttcctccctggtnattttaggntaaagatcgaggtccggaagccacctaggagattttttaattggttttattggagcattaacctgggagcgatcctgtcgttaggtggcattgcctatattcagcagaacgtcagctttgtcactggttatgcgatccccactgtctgcgtcggccttgcttttgtggycttcctctgtggccagagcgttttcatcaccaagcctcctgatggcagtgccttcaccgayatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcrgcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccaaaaaaaaaaaaaaaaaaaaaaaaaaaaaaaaaaaaaaaaaaaaaaaaaaaaaaaaaaactcga

SEQ ID NO: 1755 - DNA, 2127 bp, Homo sapiens
  misc_feature (72)..(72): n equals a,t,g, or c
  misc_feature (141)..(141): n equals a,t,g, or c
  misc_feature (294)..(294): n equals a,t,g, or c
  misc_feature (303)..(303): n equals a,t,g, or c
  misc_feature (1938)..(1938): n equals a,t,g, or c
  misc_feature (2045)..(2045): n equals a,t,g, or c
  misc_feature (2117)..(2117): n equals a,t,g, or c
  misc_feature (2121)..(2121): n equals a,t,g, or c
attctacagcagaatatacttggaaaaactcaagtttttccacatacttggaaaaactctctagcatttgtnggaatttagtgtaattaagtgaaacctacctagcaactgtagtaattaaaagcgtggggtgtgcttttngttgagatccgtgaatgtttctgtaaacacaattttgattgtgttgcgcttcttaaaggttgtgatgacaacggtaattttaaccacttgaccgtatatcgttttcatccttgaagactgtcatatatttccaagtgtctttcctccctggtnattttaggntaaagatcgaggtccggaagccacctaggagattttttaattggttttattggagcattaacctgggagcgatcctgtcgttaggtggcattgcctatattcagcagaacgtcagctttgtcactggttatgcgatccccactgtctgcgtcggccttgcttttgtggycttcctctgtggccagagcgttttcatcaccaagcctcctgatggcagtgccttcaccgayatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcrgcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttccttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggantttttttttttttaaagataaaagcatggtcagatgctgcaaggattttacataaatgccatatttatggtttccttcctgagaacaatcttgctcttgccatgaanttgaaaaggctggtagtaaacacatttcatctgctgcttcaaaaagtacggggctttttggcccaaaagccntccntacggg

SEQ ID NO: 1756 - DNA, 1105 bp, Homo sapiens
ggcacgaggaacagaaaccagagcacagaaaatctttaatgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaaggctgttgagaaaagaggtctagatgttgatggaatatatcgagtttagtgggcaatctggcaacaatacagaagtttaagatttattgtcaaccaagtcgtttctggaataccagcccttctatcagaactggatggagacctgtggacacccctaagtaagctgcagatttttcacagtggtcatttgacctccagagcaagccaataatttgtcacttcattaaactgaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaccaggaaacatggcgatccacatggtctaccagaaccagatagctgagctcatgctgagtgagttcagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaataaaaaaaaaaaaaaaaaaaaaaaaa

SEQ ID NO: 1757 - DNA, 1274 bp, Homo sapiens
ggctgatctcaaactcctgarctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcttcattgtcacctaccctggcataccacacccattcctaatatttgtctcagctcccccttctctctragtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgkttgatgtttttatagtgagaccatatttatgtaatatttgtataattttttaaatagaccaagctgggtgtggtggtatatgcctgtgttcccagctacttgggaggctgaagcaggagaatcgcctgaacctgggaggtgaggttgcagtgagccaagatcccgccattgcactacagcctggacgacaagagcgaaactccatctcaaaaaaaaaaaaaaaaaactcgag

SEQ ID NO: 1758 - DNA, 1491 bp, Homo sapiens
ggcacgagattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaaaaaaaaaaaaaaaaa

SEQ ID NO: 1759 - DNA, 3045 bp, Homo sapiens
  misc_feature (128)..(128): n equals a,t,g, or c
  misc_feature (141)..(141): n equals a,t,g, or c
  misc_feature (739)..(739): n equals a,t,g, or c
  misc_feature (770)..(770): n equals a,t,g, or c
cccagaattgtccctccaaagcccccaccccataaaagccattgtcctcctcctccgacccttctggtatccttgttaagagagccttttccactgtgaggaagtgtggaaaaatagcctctgtgtgngtgtgtgtgtgtntgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatatttwatataaaatccatccaaattaagttttgggtaagtgtgttgtttaatctgaactatagtaacttaatactctaaacaatagttcactccatttggtcctttctccacagatgtaattatgttttcaactcaggaactatggncaaggaactttccccagatcaaattcyattnaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgktcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttggccttttgtacaaagattagtttcaatgtagtctgtagcctcctttgtaaaccaattaaaaagttttttaataa

SEQ ID NO: 1760 - DNA, 880 bp, Homo sapiens
ggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataaaaaaaaaaaaaaaaaa

SEQ ID NO: 1761 - DNA, 1154 bp, Homo sapiens
aagctgtctatagctgcttcctaaacgttttacctccacatcatgattctctgtgggctttctttcctggttctattactgcgtactgatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggttcaagagccactgccctaactgaacaagtgaggaagatgcattataaacattctccttcatgtacaagtgttgattataatgaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgctctttttttctactgtttttcttcatatgaagttccattaaagatcagcttttggcatgaaaaattaaaacttcataagacctctcagccggggatggtggttcatgtctacaatcccagcactttgggaagccgaggcaggaggatcacttgagcccaggagttcaagaccagcttgggcaacatagcgagaacccatctctttaaaatttaagtttaataaaatgtaattaaaaaaaaaaaaaaaaaa

SEQ ID NO: 1762 - DNA, 1124 bp, Homo sapiens
agaccttattaaaagcttcaagatgttagcctttatctgttccatatctagcttacttggttgtttttgggggatcacatgtctgtcctccaaactggaaacgtctaactctccaggagatgcagtagcattatttgttggacagtggcacctactggtagtttgtaatgtttatagcctagtgtgaaaggcattgtaaatgtatacctagcaaaaaggggagtagagcaaaatttccagagttttacaaatgaaatgaaggatgatatgggggagagtcctttggggccaaggagagagagcacagactagaaagtaatacaagcagaaagaaggatgtcagcccatgtctgtgtggtagaggtcatctttccatctcactgggattgtccctgaaagtgtctcactgcttaggtctccttgcctgtctaaggcttggagaccttccagtatctcatgccttattctagatctgcttttttccccgaggtgaaaaaacctgttcaaatggtcactcacaacttttgtggccttactttttgtctccgaaaggacaaacatatcagaactaacatccacccagaagaagggctgatcagttcctttcaacacagcatggatgaaaacccaggttagcgttagtgcttcttgaattggaagtattctaacctctatgtacctaccaatgtaagaactgagggcccttttaagggaacttacattcctaaagttcaagtcaagttgtcatgaagagtacttaatgaggcatacttttaatctttgaatcgtagtgttgtagggctaaaagaaacctcaggccaggctgcatggtgctcacgcctgtaatcccagtactttgggagaccaaggcaggctgatcacctaaggccagtaatttgagaccagcccaaccaacctggtgaaaccctgtctccactaaaaatacaaaattagcctggtgtggtgatgcatgcgtgtaatcctaactactcgggaggctaaggcagaagaattgtttgaacccgggaggcggaggtttcagtgagccgagatcatgccattgcactccagcctgggtgacaggagccaaactccgtctcaaaaaaaaaaaaaaaaaaaaaaaa

SEQ ID NO: 1763 - DNA, 816 bp, Homo sapiens
  misc_feature (720)..(720): n equals a,t,g, or c
  misc_feature (735)..(735): n equals a,t,g, or c
gacacgaggtcactccaaaaagaaaccctgtacccactagcagtcacccatttcctccatccttccccatccccagccctaggcaaccatctgttttctgtctctacagatttgcctattcaagacatttcatataaatggaatcatacgatatgtggtcctttgtgactggtgtctctcacttaacatagcgtttttaagatccatccatgttgtagcatgtatcagtactacattccacttcattgtttaataataataataataatagttcattgtatgggaataccacgtttgtgactggcttctctcacttagcatagtgtttttaagatccatccatattgtagcattatcagtatacattccacttcattgtttgaataataataatacttcattgtgtgggtataccacatttatccatttatcagttgatggatatttgagctgtttccactttttagcaattatgaataatgcctcatctaacactttgattatactttttattatcatatgtgtggcttcaggtttttgtttggttggttggttttgcctgtgtctgtttttatcacttgattataaacttctggaaaaagatcattattttcactctgaaatttccatacagcaagtattcaataagtgtttggcagatggatgaatgggcagatattataggttcttaccatgttgattatgaagaagtacaaagtnttcagaataaaaacnctaagcacagtaataaaaaaaaaaaaaaaaaaaaaaaaaaaaaaaaaaaaaaaaaaaaaaaaaaaaaaaaaaaaaaaaaaa

SEQ ID NO: 1764 - DNA, 1232 bp, Homo sapiens
ggcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccaaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaagcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggtcacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgtgcgctcagttctttgttggatttcttgtttgtgttcttaaaaaaataaaaaaaactgatttccaaaaaaaaaaaaaaaaaaaaaaaaaaaaaaaaa

SEQ ID NO: 1765 - DNA, 854 bp, Homo sapiens
ggcacgagaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctctaaccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgaaaaaaaaaaaaaaaaaaa

SEQ ID NO: 1766 - DNA, 2092 bp, Homo sapiens
ggcacgaggcaatttgaagcaatatgtgggaattagtgacttaacaaaagactacacaaacatgaggatggcctttatttttaaaaggagctttaaacaaaaatgcctttctttaagcttaatttttataatatcttgcatatatctttattatcacattgttattgttacatgcactggtgttttctctctggattaagattgccatctttatataaaatggaatacatgattattccatcacaactagtgataataaaaacagctaatgtttgttggcacatctgtgccagcactattctaaatgcttaattttaatcatcacaacaaccctatgaggtagatattgttatccctgtttttcagatgaggaagccgaggcagagagaacttaagttgctggcccaaggacaaacagctagtagacagcagtcaaggcagcgtggctccatggtgatgtgcttggtcagagatctgaatatataggacttagatttgtagactattgagctgtagactcatttagacaaatggtaccaagatattttagtagataaaattctaggttagtagaacatagaccacatgttataagctgatatcagttgatggaagaaaaatggttttacaagttattttcaggatctctatcaaacctttacttctccctctaattacagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgtatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaaaaaaaaaaaaaaaaaa

SEQ ID NO: 1767 - DNA, 1352 bp, Homo sapiens
ggcagagaaatcattgagtgtaaatagtcagatgaagaatgtatattctgtttttaagctcagtgttaatcatgggtgcatttttaaaactaatttcttattttcccatttacatatgatgaaactcactgattttggcatacagctatatgagtattgacaaacagtcctagtcctgcaaccatcaccacagattaggaacatttccatcacccctagaaattccctcgtgcccctttgtagtcattccctgcatctgggcaactaccaatctgtttgctgtccctgtggtttctaggcattattggaaacctgttttgtttataaccccttttcacctcctcttctgtgttcctytctgagcctacagtctctgttttcctgctccacacacaagtcggcctgctttattatcccaacactcctcctcctggggtagaatttctcacatcctcaatgagatggagcttggctgaatgtgagggaaggaatctgttttaatgtttgcctttggttccttgctttgtatttagagaatctgtttagttccccagatgaatctctgtttttagggattgtgacagttttaacataggtggaaatgaaagatcactggtgcagggcgacgagcatgtttgacactgatacttttccaattcctgggtattttgaaggtccagagggagccaacctgttcatctaccacctgccaggagtttggtgatcaggacctgctgcagatgtttatgccctttgggaatgtcgtgtctgccaaggttttcatagacaagcagacaaacctgagcaagtgttttggtatgttggcttctctctggtgtcaggatgggattagtattttaccactgagaaagaaggagctcactgcagaaagatctgaatatgagtttgtggtgttgttttaacttggccatgggcaggtcattatgacctctttttgagccccagtttctcattgctgtagtggaggtaaggatttctacccacactgttgctccagagagaaaaataatatatggaaaatggtttgcaaaaaaacctttaaacagtccaggtttgtgcctgtaagtcccagtacttggggaggccaaggcaggaggatcgcttgagcctaggagttcgagaccagcctgagcaacagagtgagacctcatggctacaaaaaattagtcagacgtggtggcgtgtacctgtgttcccagctacttgaggctgaggtgagaggatcacctgagcccaggaggccaaggttgcagtgaaccatggtcacaccactgtactccaccctgggtgacagagcaagaccctgtctcaagaaaaaaaaaaaaaaaaaa

SEQ ID NO: 1768 - DNA, 1658 bp, Homo sapiens
attcggcagaggttgatcaatgttaggaagcttgctaatgacactctcatccagaacttttggagagtagggagaaactaacaaaataacagagagccgaggaattccacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctacagccacctataacttaagattctcccccacacagcccagacatacacacaacgctaagatctgaatgcctgtgcccccaaaaattcataagttgaaatcctaacccccaaggtgatgtgaaaaatgtaccaaaccctgtccagaattttggaatcgcctcccagatactttatctagagactctttgtyctacttccccacaagtttttcattccagtatttaatcattgagtgtttctgcttgtgatacttgttgcaaagtcaatgatagtcaaagaagttcaaaaattggttactttggacttaacaagcaaatgcacttctaggtggcttttgaaaaccaaaagtacacctaagtagagagcttctgttttttatagtgattatatgaagagtaatgggtgaaaagcatcaaagctggaattggagctctggggtctacaccgtttccaatgaatcattcctaatgtgatgctttcatccatgctcttggctctgtctgggatgtctcctctccgccaggccctgatttcagtcatccaggccgagtttaattatgtataactgtcttcgtttatttggggcactaaaacaaaaataacaaaaatactatagactgggtgtcctaaacaccaaaagtttattactcacagttctgcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctycactctcacagsctaatgacctyccaaagggcccagcttcaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagcctccactaatccttctactgatgtcttctatattcgtgattcagatgtgccttgtagacaagcacagatcttcactgctcacttctgccataaatgcttcacaaattaaaaaaaaaaaaaaaaaactcga

SEQ ID NO: 1769 - DNA, 774 bp, Homo sapiens
tttaagttacaggataattcctcccagtaaaactagcctccaaaggttttaatggcaaaatccaagtattcaaatctataatcagccttttaagcaggaacttaaaatgacatgacagttttaattatcttgttcttcgtccaagagtcaagtagtaggcatgagtacactttttacatggcttatggttttacgttatcttctaccaaacagctgttttgtacttaataggcctagtttctgtaacccatttggaacttcccccatcagctgtcgaaaggcttcaagttgagaaacactgcactgtggcttcttcaaatggcttttctttttttgagatagggtctcaatgtcacccaggctggagtgcagtggtgccatcatggctcactgcagcctcgacttcctgggctcaagccatccccctatctctcagcctcccaagtagctgggactacagctcgcgccactgcacctagctaaattttatattttttggagagacggggttttgccatgttgctcaggctgatctttaactcttgggctcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattctttaaaaaaaaaaaaaaaaaa

SEQ ID NO: 1770 - DNA, 411 bp, Homo sapiens
cccacgcgtccgacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctctttaaaaaaaaaaaaaaa

SEQ ID NO: 1771 - DNA, 779 bp, Homo sapiens
  misc_feature (709)..(709): n equals a,t,g, or c
ccgaggagtccgcccggaaacaaacattccccagggcaatgtcacgacttggtcttcccgaggagccagtcagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctggagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcttcttttccagttgccttctattgtctgaaaaagtaaaagccattcaaaaatgaaaactatgttcatagtgttgcatattttcacccacaatatgttaataatatttttcttacacatataataaagaatatntggcacatactaggcccttaataaagattttttgaatataaaaaaaaaaaaaaaaaaaaagggcggccgc

SEQ ID NO: 1772 - DNA, 638 bp, Homo sapiens
  misc_feature (9)..(9): n equals a,t,g, or c
  misc_feature (38)..(38): n equals a,t,g, or c
  misc_feature (66)..(66): n equals a,t,g, or c
  misc_feature (625)..(625): n equals a,t,g, or c
  misc_feature (635)..(635): n equals a,t,g, or c
tgccagtgngcccttggaacatccccactgcatttcanccccggggggatacagtgagacccttgnctttaaaaaaaaaaatgcctgcaaaccccaaaaataaatagcccataatttgcccatctttggagagattatggagataatctcccttgtctattagcccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagtatggcatgtatcttatttttgaatgcattcctccttatccccatcctcttaggaatatggacgttttactaagtaataaagatttcaaatgctaaaaaaaaaaaaaaaaaaaaaaaagggcggccgctctagaggatcccgsgaggggccccaggttantccaaagagntcc

SEQ ID NO: 1773 - DNA, 1055 bp, Homo sapiens
cgggtcgacccacgcgtccgagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaaaaaaaaaaaaaaaaaaaaaaaaaaaaa

SEQ ID NO: 1774 - DNA, 1161 bp, Homo sapiens
ccacgcgtccggccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgccagatgcttcaggggcccggcttttcaggcttgccctcaccagcggccgtcagccgacactcaggatgtagctaacaccactccgccagtgctttcagtaggaagagctgaggctgcctggaaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgactttaaaaaaaaaaaaaaaaaaa

SEQ ID NO: 1775 - DNA, 1681 bp, Homo sapiens
aattcccgggtcgacccacgcgtccgctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctgggaaaaacaactggatgaactactaagtttgaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacaggttcagaattccaggccatcaaaacggccaccaccttggcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaagataaaaaaaaaaaaaaaagggcggccgctctagaggatccc

SEQ ID NO: 1776 - DNA, 678 bp, Homo sapiens
cacgcgtccggatttttcactaattggtttgtttgaattatctagatactctttcataataattctatattgcttatgacttgagtctttgaacaagaatggtaagtggcctcataaaacatagcaattggctgtgtttcaccttagcactagtacatgccaaatgcagcatctctttttctttgttacattgtagctttgccatgctgttatgcagtggcttggatgtaatcttttagtcatagtggagtggtttggattaatttgttgcattttactaatggacacaaaagcatagtatcctgttaattaactggtcacaaacttataaagggacttcctttagagttaaagatttagagttaaaggttaaaggtttaggttgggtgccctggctcatgcctacagtcccagcactttgggaggccaaggcaggcagatcacttgaggccatgagttcgagaccagcctggccaacatggtgaaatcccgtctttacaaaaaatacaaaaaattactggtgtggtggtgggtgcttgtatcccagctacttgggaagctgaggcacaaaaattgcttgaacccaagaagcggaagttgcaattgaaatcatgccactgcactccaacccgatgacagaacaagacctatctcaaaaaaaaaaaaaaaaaaaaaaaa

SEQ ID NO: 1777 - DNA, 610 bp, Homo sapiens
aattcccgggtcgacccacgcctccgaaaaaaagaaaagaaaaaaagaaagagtgctttcctcttagaattgtgagatgggtataaaagtaaaataatttagcacagtgtcttgtacatagttaatgtgtgagacttattattaagttaaaaagcaaccacattttcacattttgcattttagaaagatattttaaacgtatttcacatttgcctgatgatacattattccttattatgtggtttctgtcactgctgttgtcattcatttgctttttaatatctgcagaatatgaaatatgtctcttttaagttcttattattagtgtgtgtgtgcacacctgtgtgtgttttttcatctgtctcagtaggagtaccgttcaatttggtttttcaaagaaagtaacttttgactttgttgactctgtctttttattatttctttcattaacttttattctaatctgtattacttccttccatctaatttatttttattttattttgttttattttttgagacagagtctcactccagcctggatgacagagtgagactccagtgagactcttatcaaaaaaaaaaaaaaaaaaaaaaaaaaaaaaaaaaa

SEQ ID NO: 1778 - DNA, 1264 bp, Homo sapiens
cggcacgagtcttttttttggcctgtcttacctacagttgtattttcctctttaatcataaggatttacatcaggaaaaataacctgagaatagatgtgttttgtttgaatgtcgtagttgtgccctttgtaaaattaccccagggcatgataagaaaaggagtaagcaattaaaatgcacagggctacggcaagggcaggcagatctgagtggaggctgctgtcctgtgaagtagacctggcaggggatggctgctccgggctggcctgggcctcgctctgcctctgttgttgctctgacctttgacaaatcattcccttgcctgtgtctcggttgccccatctgagcgagaggctggactaaaaggtcactaaggtcacttgtagcctgaccttccatggctctataattctctttgttatctttggccacttacatgtttgccatgatcattgccaatcaaactaggaatgtttagcagattttagacactcagactggaaaatacagacgaggccatagaagttagtgttgtcctagggatggctcctggttcacgcaggctcctcatagggtccctgccgctacacaccacgagcccaccgagactgctgcagcctcgctcatccagaacagaggcaccatggccaggaggcccttcctttgttgggtaggagctgcccccgtccatgttccagctcctcccaggcccccatggataaaatagggccacaggtgacaagtgagttctgtgaccctgaccggcagcagctgccagcgaaggaggaaggaaacacagacaggaggtctcagagcacagcacgccagacctctagtccacacagtcctgcacacattgccgtctttgtttaaagagaggcggaggcagaccccaggcattcaaatgatagaatgcttctgctgtgcctgcatccttccctcctccactaggagcctctggttccagcccagatgaacccactgggctgggaacgccacacaaaagcactctccaagccagccagaggtccctgagggccaagacagggctgaccagaggcagtgtctggacatcctactgggagctcgggaggaggcagtgacagctcaggccagtaatgggtattcttgagagcaatcccaggtcatcaagggaagaaaaggttatgcttcgtatactgtgttcaggggccagataagttttaatacgttccagaagtgtgctcaagcaaaaaaaaaaaaaaaaaactcgagggggggccc

SEQ ID NO: 1779 - DNA, 942 bp, Homo sapiens
  misc_feature (437)..(437): n equals a,t,g, or c
ctgcaggaattcgscacgagccagctcgaaaaaatccatgcttttgagaccgagaatctgggaggagttttgagtcatgggcgtgaatgcaaaaggagagtaagagaatgggacgagacggggcagagccgagaatattacaaagaagggctaagctatgggcttcctttctgtctggttcttgcttgcatcttgccatgctatcatttgctacttttcttgcctcggtggtttgtaaaaaataagagccccgggtgcatgtgtcccctcattcactctgtgtgggcaaaggaaaatgaagcccttatggtcacctggtgtttctaactttaaaacagcctcatatctcttatttaattcacacagaaatcctgtgtgcagagccaaggatattcccattttatagacaaggaaatggagaaaaaggttgagaaaankgatcttccagtcacatttacctmttcctgcctcccacaagtgcttcctgggtcctatcccagggtttttttgtactttactgattttaacaaatacagcctttgatcactctcagctacctgccacactggtgccatcactaggtgagttataaagactcatcatcatgatactctccatgattgggagcattctatgtgccaggaatttttctgggggcttttcacatcgtatttccttctgatccccacaactctcctttgagatacacagtgttatgatgcccattgtacagatgaggtgaggtgctttaggccacacagccccagccaacacatgcagacatcacatagctaggaaatgcgaatccagcatctgaatgtgttagcacagagggtcccctccctggataaaccttctggaactcccggtcatgtaagacaatgtccaaattcctcagtgtggtgtgcatgcacccctgcagccactgccctgcccctcgag

SEQ ID NO: 1780 - DNA, 1522 bp, Homo sapiens
  misc_feature (1)..(1): n equals a,t,g, or c
  misc_feature (357)..(357): n equals a,t,g, or c
nccccgggctgcaggaattcggcacgagagagagaacgcatgcaaactccatctcaaaaaaaatgtattgtttatctgcaattctgatttaattgggcatcctggattttccctggcaattgtattcctggagcaacaagaggactctcaacaccaaacaggccatcccgttcctccatcaggtccctacagcatttgaagtaaaatccaaaagtcctggcttcgcctgcaaggccctgcatggctgaaaggaaacagcagccagccccacagactttgaggagttcccagggtggatcaggcaggcaagtggattttgtggtcctggtccctcacggttgtctgttcccccacatnctcctagaaccccttgttcgtggaggctgaggagaaagtctcctacaactgctgccgccarggcactgtctgtttgcaaatccagatggaaaggaacaccttcacgccaggagagaaggtcgtcttcacaacagagrtcaacwwccakaccagcaaatgcatcaagacggtcgtattcgccctgtatgcccacatacagtacgagggcttcacgcccagtgcagagcggcggtctcggctggacagcagcgagcttctgaggcaggaggccaacacccccgtgacccgcttcaacaccaccaaggttgtcagcaccttcaacctgccgttgctgctgtccgtgagcagcagcacgcaggacggtgagatcatgcacactcgctacgagctggtcaccaccgtgcacctgccytggtccctgaccagcytcaaggccaaagttcccatcatcatcaccagcgcctcagtggactctgccatctgccagctgtcagaggacggagtgttacccgtgaacccagatcaccagaattaagtgcccgaacttttaaatattaaaagctttattagtctctaccaggaggaagccctctctcttgcacaggtgactctcagaggagtcgaggagtgggcaacaggttgtctgcaacctccccaagctctagcggtttaggtatctgtgtctcccctccctagaactatcactgaatgcctggaatggacaaaggaaaccgggaagktctcccaggacccaaacccggcataacctgccttttccaccctgaktctgccccagcctactggggtctcacagtgccaagaccaggggtcctacttggggagaattctcccctctgctaatgtctggtttattggctgtcacaactgcaggggatcgggggagaagagtcttattggcgtggagagggtggaggccagggacgctgttcagcaccctgcagtgtccaggacggcccccacaatcaggaattgtttatcctgaatgtcaacagtaccaagggggctgagcatggtggctcattcctgtaatcccaggactttgggaggccatggctggaggatcacttgagaccaggagtttgagacaagcctgggcaacactgtgagacccccatctctacaaaaaaaaaaaaaaaaaactcga

SEQ ID NO: 1781 - DNA, 1446 bp, Homo sapiens
ggcacgaggtagctgccagcaccattgttgttaacttggctctggtgtggtcgcacaggtacagcacctggtgcacaggaggctctgaaaccacaggcccttccccattgccctttcccccctgttctgggcttgacccttcctgtgagggcctggacctcctgcttccgctatctcccagtggctggctcagcatggctctttctcatttgctccttcattctcgcccactccttgaggtctgtctatctcacgtcctgctgtcccctcatgaacgcccccttcttctctttccctgcctcctttctggtctctctggggctgtcctcagagtccttcttgggtagtttcagggctgctgccaagtccacccwgwgcgcccctgcgctctgccccaagcagtctggagcaggcacttttcccagaacactggggtttggaaaacagaacgtccctttaggcctctgtgacctgctcccaacttttagatgagtttactcaacctttggcttccgggtgcaggctctgcctcctctggggccgtctcacctgtgcagggacagcagctgattctgatactggattccaartgggctccctggggccttccttgtgggcaccctgagctctttcaaggccattccccacctcacttccacaagtgagctgggctggctgcagggaaagggcgcatgtgtctcttgagagaagctggcasgcggccagcattcctgcctctggatggagagccagaaggctgagctctgaaaggcccaggagattgggcaatggtgggtggatctccccacctgaatctgatgtgggtgcagcaatgcctggaatgacttggtgactgctgactgtgtttgtccttgcctgggtcatgcagggcaccacccatccaggatatgggtcaggggaggtctctgactcacagtgcttctgggcgaattcaaaagcagaggctccttgggtgtcagaagtggaaaacgggagggagtgttttaaaaacccacctcccatcctccagaagggaaaccaggacccagaagagcaaagtctcatgcatctcaactacctgcttagcatcttagaggcagcagtagtgtgtcgccattaagaacacagagggccgggcgcagtagctcacgcctgtaatcccagcactttgggagaccgaggarggtggatcatgaggtcagaagatcgargccatcctggctaacacagtgaaacccccccatctctactaaaaatataaaaaaattagccaggtgtggtggcacacgcttgtaatcccagctactcgggaggctgaggcaggagaatcacttgaacccaggaggcggaggttgcagtgagctgaggtggcaccgctgcactccagccwgggggacagagcgagactctgtctcaaaaaaaaaaaaaaaaaaaaaaaaaaaaaaa

SEQ ID NO: 1782 - DNA, 1193 bp, Homo sapiens
ggctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaagtcattgccctgcgagggtctccctcattgagaatctggatcccctcatgtgcacatggtgaggtcagagtcccctcctcacagtgtccccttccacctcccgtgaactgttctttccttccaggaggccagcaagcgcatctccagccacatccctttgatcatccagttcttcatgctccagacgtacggccagcagcttcagaagggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaaaaaaaaaaaaaaaaaaa

SEQ ID NO: 1783 - DNA, 921 bp, Homo sapiens
  misc_feature (773)..(773): n equals a,t,g, or c
  misc_feature (813)..(813): n equals a,t,g, or c
  misc_feature (851)..(851): n equals a,t,g, or c
  misc_feature (885)..(885): n equals a,t,g, or c
agatgctagtactttaaaaggaaataagggaaaagccggtcttaactatatagatttttttttaacataaatggctgctatttggcactttgctttttgcacttacctagatgtcctggacatctctccacgtccacttatagacaactgcccaggtgttttcctggctgcagagatgatgtggactgaattcatttggccaatccccaggcaatggccacttaggttatttcccaagttttgacaccacaaacaaagctgcagcgagtgaatcagcttgtctgggctcgtgtgtctgtgaaaactatgtggcaacactgaaacagattgcacacccaaagcctgacttctggctcctcttgggaatcagaagctctgcctccctggcccacacgccatacttttagaagccccactgccccagagccctatttgtccatgaattcctgactcattgtctggagcctgcttgagggaggctgggcagggtgtgagccaccaggattaaaggttgtttgtagcctctgcctccaaatagttacctgcaaaaggggacaagtgaagccacaaagattctactttaaaaaaaraaaaaraaractcattaaagttcccttaggtgtctccagagagagcccagaggggcccaggagaccagagttctggtcctgtctgtcaaagaattggtctgtcagagaattgggccactctctgaagggccccatccttggtttaatgcatccagccctgactgtttgaccttggtgaggggnctcagtgacgtcatctgtgaaatgggtacagactccttgngggagtctgtaagctcagctgtggttggcaatatagangcataaacaaagttgaaaagctcctggccagtgnggtggctcacacctgtaatcccagcactttgggagg

SEQ ID NO: 1784 - DNA, 1059 bp, Homo sapiens
ggcacgagcaccccaggtccatgagggcggggacttttgattggtttgctgttgcctgtcaagagctttatttactccgtgcacaaatgactgaatcagtccagccctcagtgattcatctgttttccctcttccttttcccatatcgggtgtgcgaacctctgctcaccaagtaccagtcgggtccttctcctgcccacgtgaaggaagaaggcgcagtggggctgaggcctcactagggcacccacacggagcgctgcgctcagcctttggacccggtacctccccaggctctgaggacagcagcagccccaggacggacgggtacgccaagtcctggggaccctctcccaagctctgtcagggcggcggggtggcgcgcgctcctccctcgggcgctagctctggaaatcgcgctaggcagaggtgggcttgtgtccgcacccgcagcctccgcgtcaacaccctaggggagagggacgcgggcaggggtgccgggcccaggctccccagccattctcaggccagaaccccctttttaacaagacatggccttggtgtgtcgcggactctgccggggacagtctggcagaactgggctccttgcgctccccagtataccggctaattccgtgccctttgcaaacttcatattttgatttcaaatttaaaaataatcaataggccgggtgcggtagctagctcctgtaatctcagcctcccaaagtgttggcattacaggtgtgtgctatcacgctggccttatttttattttttgaaatggagtcttgctctgttgcccaggcaggagcgtagtggctcgatcatggctcactgtagcctccgcctcaccctcccgaatagctgggactataggtgcgtgccacggtgcctggcccgaatggctttgttatacccacgtgaacagtactacgttttactaacagaaaagcatcaaatgagacttttcttccgaaactatgttcagagagtgactgcagtattgccttggcaatctagtgaatgtatcctcaccgcattaaaaaaaaaaaaaaaaaa

SEQ ID NO: 1785 - DNA, 590 bp, Homo sapiens
ggcacgagggtggatgcctgtagtcccagctactagggaggccaaggcaggagaatcgcttgaatctgggaggtggaggttgcagtgagccgagatcacaccactgcaccccagcctgggcaacgagtgaaacttcctctcaaaaaaaaaacactgcactgagaggcagaagacctaatctcctgaacctctgtgtatctcagtgtcatcatggacatgatgagactggataagcctcagagcctctggggaaggctgtttgcaaacatgaccacagtttctcccatccctataagttgcctctttgcagcttgacattgctgcttctcttgtcaagaagtggagatttttttcccctctccttgaatctgggctagctctgtaacttgctttgaccaatagacagaagtgacctgatgtgacttttgagtctaagccttaattgcctccactgtcaccgtcttggagcgatagtgtagccctgtgaagaagcctgggctggcttccttgaggataaaagaccaggtgccacagaaaggcagtcatgtgagtcagccccaggcaaaaccagcaaaaaaaaaaaaaaaaaa

SEQ ID NO: 1786 - DNA, 965 bp, Homo sapiens
  misc_feature (193)..(193): n equals a,t,g, or c
  misc_feature (643)..(643): n equals a,t,g, or c
gcagctctagaaatctttccttctggtgctctgatttgcctgcctctgggaggaagggaagggaagaccctgcaggactgaggtttgtcctggctgacaggcctgccaggcttgttccgggctgcagagaagagaggctatttttgttgtgggagctgaattgttggtctctctccaggagcacatgcttgtnggtgtggttgatgtrtcttgcctgctgtggccatctctaccactgcttccagaaaacacttgagaatacgtttgtcccaagaggttaaacctgagatcaggatcaggcatctgtgctcttgtcttgtgttccactcccttctggccattggaagggcagtagcagaacaggatatggctaacatgaacttggagagacttttctcctagagctgtgcttgaaaggggccctctctctgtaactgcggttgcagtgaactcagtccawtayctgggctttcttgtccttcagtaggctgatggagctgcccttgccctcaccagcctggtggggtttgcacagtgctgcagttcatctcacctactgtccaaatctccttttatcagcccagtccaggaacagtggtgtccttcttggtgtagggcttaacgtgagccttgcatgcacctngatccatatccagcattgcaggcaattctagtattccatgtcaagaaggctggcaagaaggctggtggggcaggtgccccagtccatcggcccttagtatatgcagagggtagctccaagtggggccactgtgatatgaaggaggattgtttgaattcaggagattgaggctgcagcgagcagtggtgcagtcatagctcattgcagcctccaactcttgggctcaagtgatcctcctatctcaacctcttgctgagtagctaggagtactggtgcatgccaccacatccagctaattaaaaaaaaaaaaaaaaaactcgag

SEQ ID NO: 1787 - DNA, 1175 bp, Homo sapiens
ttttttttttttttttttttttttttttttggccgagtcaatattttattaaaaaacacacaaacacatgcacactggtaacaaaggcagagatggagaggagacacaagatctccttggggacaggctgaccacatagtgtttctacaggcacgcctcacttcaggaaagagggtatctctaagaccggactgacaagctagataaattaggacagggctttgtttcttaaggcacttcactcccctgaggagtgaagtagaagggatttaggcgggagtattcacaaaccccttcagctgtgctaagtggggttcatcagtacctgaggtggttctagaagcaggaaggcagaaaacatttccctggaggctgctttcctttcccagaatgggagggatgttctccccggaaggctggaggaagagtttccggctggctcaggagctcagggagctggcttcctgggagagcaggaagagggtgcaggcctttcctggtgcccaccagcctgacaggactttggcacaggaacacaggtccagaggcctcgcctggagtacacgtcctcctctctgcaaagctcctgaggggcctaggggttgtggcctcatcagacggctgcatctgtggactgggttacacacgagatcttataggacagccatatgcttgccatgcagaggaaggtggccatgaaaccaaagatcgctccggctaccagtccgctctggttgtaactcttggaagctgccacaatggaggcgatgaggaggagcagggtaccgattaaatagtgcagaagttccgacaggggccagctgatacaggtgagcacgcggtagaagcggaagaggtggaccaggtaaaaggcgaggatcattatcaagtcgcaaatggtgaccacttcaaagtagctgtaggcgctgtagttggtccacagggagctccgcacacagatgaaggcaatcagcagggtgaccatttgcgccactttcagcagggccgcgtgggtgcgggggtagctgaggtccagcagcccctccaaggggctcgcgctgggctgggccgcgccggccccgggtccgagcgcgctgccgctgctgcacgtggtgcggacgagcccggctccgtgcgacattgcgcggccccagctcgccggacgcgtgggtcga

SEQ ID NO: 1788 - DNA, 1340 bp, Homo sapiens
ggcacgagcccactcttgacctcaaggtggggaaggcagcgcgtgggggctgccgtcaggaagttttcataactgggcacgaggaggcaggaggagctgcccgtcaagcttggtgtgggcagtaccgaggcccaggctggatgcagagccgggaaccgcctcctgtgtgcttcatggccatggtcctttctgcctgtgttttttctttttttctcaaccgtctcttttctggctcccttatttctctgtctgcctcccggtccctcttttgccttgggtgtttctctcctgccgtcccgtccacacgcttcccgggttcctgcccgcccagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacgtggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcccgtgcagggcacctgcgtggctgacagccaggctcttactccagccggggctgccagcgcatccagccagcccagccctgtgaaagatggagctgacttgctgcaggggacctgatttatagggcaagagaagtcacactctggcctctcagaattcacttgaggttcaattaaatacagtcacaccgccccctcaaaaaaaaaaaaaaaaaaaaaaaaaaaaaaaaaaaaaaaaaaaaa

SEQ ID NO: 1789 - DNA, 656 bp, Homo sapiens
ggcacgagcttaattagaaaatgcttcattgctttaaaaaaaaaaaaatgctaatgatcgtgctgggattacaagcgtgaccactacacccggcctgagtcacattgttcttaatagcatctagaatggtgaatccttcccaggaggttttcagtgtactttgcccaaatccatcagaggaatggctgtctatggcagctatagccttataaagtgtatttcttaaataataaaactagaaagtcaaaattactccttgatttgcaagaattactgcctggctgcaagaatggatgttgtgttagcaggcatgaacacaacattcatctccttatacatcttcatcagagctctgggtgacttaggtgcattgtcagtgagcagatttttgggtttttttgtttgtttgtttgttttgagacagtctccctctgttgcccaggctggagcacagtggtgcaatctcagctcaccacaacctctgcctcccaggttcaagcaattctcctgcctcagctacttgggaagctgaggtgggaggatcacttgagccgaggaggcagagattacagtgagccaagatcatgccactgcactgtagcctgggtgacagaaccagaccctgtctcaaaaaaaaaaaaaaaaaaaaaaaaaaa

SEQ ID NO: 1790 - DNA, 927 bp, Homo sapiens
ggcacgagcagtttttctccttttgcctattaatgtaatgactattgaaatagatttcccagtgggaagacgtttcacgctgaaggaccagtgtgtgcagaggtgaaggcaagagctgcggcagatgggcgaaatgggtgtcatgtgtttgatatcatctatgcagaaatcattagagttggctgcagctgcttggtctttttctgtaaacagccatcttgctgtcctcagatgctggacagtgttaggtctgggaaggtgggcagaggcatgatgcttgcccttttcattgtgctacttcttatccctcccagacaaaatgaaaatcaaatgccgtttccagaaggcctatcggagggctttggaccatgaggaggaggccctgtcatcgggcagtgtgcaaggtatgggaagggatgagcacaccattttaatgtgaagccctctttttccttctgatctctaagtgcatagttcccatgctttggcttacttccaaaacctctcttggaatgctgggaatgaggaactgtgggattcagcccagtccactgagggccagagaggttgattggcttacccaagcctgaccactgtgtcagctgaatgtgagttgaaggggtgggttaagcattcttttggggctggggggagatggaatggtgttttgctcttggtgtaccacctgttcttgcccccagaggcagaagccatgttagatgagcctcaggaacaagcggagggctccctgactgtgtacgtgatatctgaacactcctcacttcttccccaggtaaggtaacagagaagctgcgactttgccttatcccttcagctcgtggactcctgggtcacctccttcttgcatcattgctacccatttcttccatttgctacagaaaactctccaaaaaaaaaaaaaaaaaa

SEQ ID NO: 1791 - DNA, 1635 bp, Homo sapiens
ggcacgagctcgtgccgtggacttttaaactcagtgccctggacacgtgttgctcttctgcagtcagtggtgtggggacctgtgcctgcatcccatgatgctgtctgccactgcccaaaatgtatgggtctacaagtcacacctcccttgtcattcactgggctctggttcgtggtgatggcaaacatgggatggcagcgaaccatactgacaaaggttgaggcccttcagcatggtgtgcagcctctcagcatggacagtgggccctgaagccactgcagctcactgttcctctcccaccctacaggaggtagattgggaagtggagctggccgtggtcattggaaagaaaggcaagcacatcaaggtgaggtggaaagggtgggctcccagtccagagtgcagcagaggccccagctcctgcctctcctagttctgacctcactcaccaacacacggtgccagctgtccctgacactaggaagcagtcagcctccttgctccctgacactgcctttcccttcacccacctttggctggctctggctactaacatgggataacagcttagagatcccttgccataggtgttggtgtcacccatgatctaacctcctgtatggccaaatcccctgcccccataggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcaggtaggtccctggtccctgcccccttatacctaccattgcacagatgaacagcgcttcagggaggagcatgggttcaggtacatgtggcacctgccctccctggccgccctttcactgctgactccatacagggcaagtctcttatcctcagccacgagttctcccatgggcttccttcccaagccccctagagggaacacaactgcagaggatgtgaaactgcatgcgtgaagtaaattacaaagaacactgagctgatgggtggatcgggcttcctgcggctgccacctctgaaacaatctaagttgagcatcatggagcatagttatcccaaggccaaggcattttccacactacaggagatgaaagccagtgtgactcacccagccactgtggaaatagaacagcactgaccacacacagtcaggatacagcgccaggatgggggcagtgccccagagggcagagcgcagcctcttacacagccacccacaactgtggtggaggtggggggtgtccacatgggccagccatgccaggataccaaagaccccagtgcctcagcaccccatgcagagtcctcagcaaagttaaattgtgtttcagctgctctacttaaggggggtagaacactaggaccaccaccaacagtaaaaagtgctggttagccaggatgttcttacagtaatccatcccctgccagcatccagtacacgaggcttctctgtcccggctagaaccattgcctcactgctttatagatgctgagtcttttttttgcctgggtgacagagcaagattccgtctcaaaaaaaaaaaaaaaaaaaa

SEQ ID NO: 1792 - DNA, 1246 bp, Homo sapiens
  misc_feature (1038)..(1038): n equals a,t,g, or c
aggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtggtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggaggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtgggnagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcaaaaaaaaaaaaaaaaaaaaaaa

SEQ ID NO: 1793 - DNA, 358 bp, Homo sapiens
ggcacgagaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttctttaaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcatggctggggtttgtatctctttctttaaaaaaaaaaaaaaaaaaaaaaaaaa

SEQ ID NO: 1794 - DNA, 779 bp, Homo sapiens
tgtagtccggggacagccagccgacgtgttcccaaggctgttcaaggtaagcgtgcagagccccagagaagacagtgagattctgtccctgagggtttccccacarcctgagtgatatgatattccgactgagggaatggaaacatcagggctggtctggctgttgctgctagagaagttgggagcaaaggcagccagttagcttgctcttggaatggaaactgtgttaaggaaaaaaattctgggaaaccagtgtcttgttggaaagctctcagctcagtccagacataggatgtggtaagtcattccactctggatgccactggcttccttcaatgttttcttggctcaagccagccagatttattagggttccttctaggccaagactttgagggtggggtttcatgtctagcaaggtacatttcccatcttgctttgctctgcttattgggaaaagtcagccttttctgccgggcgaggtggctcacgcctgtaatcccagcactttgggaggccgaggcaggcagatcacgaggtcaggagatccaggccatcctggctaacatggtgaaaccccgtctctactaaaaatacaaaaaattagctgggcatgttggctggcgcctgtagtcccagctactcgagaggctgaggcaggagaatggtgtgaacccgggaggcggagctttcagtgagccgagattgtgccactgcactccagcctgggcaacagagcgagactccgtctcaaaaaaaaaaaaaaaaaaaaaaaaaaa

SEQ ID NO: 1795 - DNA, 446 bp, Homo sapiens
  misc_feature (12)..(12): n equals a,t,g, or c
  misc_feature (26)..(26): n equals a,t,g, or c
  misc_feature (441)..(441): n equals a,t,g, or c
  misc_feature (446)..(446): n equals a,t,g, or c
gctgtttcccangctaaagttccgtngcacaatcacggctcactgcatcctcaacctcatccttccaagtagctcagactataagcacacgccccgttactttgatgctcaaagtttcccaggtgtggccatgggaggcgtcagtggcttctctgttgcgtagggccattggtttgggttgctcctgagtttctgttgctagatactctgtgctcgtcttgtatgttctcaaccctggaagcagccatttctccaaggagcccttgttccctttagtggagggtggtctggatcttggttagaagccaagatcaagattctgggtgtgctcacagctctaggttgttagcagacagagctggaaagtgtgtatgtgaatacaagtgcacagttgtgggtgcgtctgtgtatgtgcgaatacatgcgtctttgtatatgatnaaaan

SEQ ID NO: 1796 - DNA, 445 bp, Homo sapiens
ggtaccgggtccggaattcccgggtcgacccacgcgtccgggaactgtgacttccccaccccaaattctatggccggctaatgttttgctatggtgactatcacccatctacctggaagcaccagaatggcttagtacagctagggagctcagccagatctcggtgtctgctgtttgagattgtgtggaaggactattgctaagaagcaggagacagactgaacccagtgttggccacaagtgaggactgagacccaggtcacctcttggctgaacatgttagcttgttggtaaatggctctgcagtggttctgcattttagtggggaatttgttttggttcattttggcattcccgcaaccatcttgttggttttttggtaaaatgtggcaccccytccagacctyttagctgtggaamtgagrtattttagcagggtcccgtt

SEQ ID NO: 1797 - DNA, 1006 bp, Homo sapiens
aggtttaggggcaggtgcagtgtcaggagtcccccagccaggccctggcactagaggccatgcggccagacttggatgtggcagtggtcttggggcaggtgctgcaggctctaccactcttcaactgtgtcttcctgttctcctcttctcccatcagcaagctcaccccctggcttttgatgccagcctcctttgtggtgtggcaggaatgtcctgggaagagacaaggcttgaccacgtggatggagtgggaagacaggaggcactggggacagcatgtggctggggtgagctagtgggcggtggtactttccccaaagtccagagcactgggtgggagcagcgctcagctgtagggatgtctggtgtgaggttcttctgggcacctggcagagatcccaggtggcaactggcagaaggtccccagctcagagtgggccctgcatggcgttgtatgctggttttcttttgtgggcaggacacctgcaagagggctacagctggagaaatgggtggggargagtggctgttgacagctccctgggcccagagagaattgagtcagaattggggaaattgcagagcgagctcaaaagcagaaacccagttgggggaaagtactgagcccagggctctaaatgactaatgcagaaatgatgttaagtttacctccagtcagagtgaaactttgggcagcccccgctccctacacgcagctgcccttcaggggaagtgagaattggcccaagccacaggtgaccatgacaggaccttgcactagctgagacccgagggtttaggaaattatatgagaaatgaagcaagagatgattatcttttgacagccaagtccccagatggaatttagatatttgaactaggcctaaggaatgtctgtctattaagtgtctgtagaaatttctgtcatctgcttgcacttgctgttttactctgctaccattcttttctctctccatctcgtaaaaaaaaaaaaaaaaaactcgag

SEQ ID NO: 1798 - DNA, 1369 bp, Homo sapiens
ggcacgagggttcacacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttgttttccttgtaataaaggacctaaaccgaaggtacctgaaaaaaaaaaaaaaaaaaaaa

SEQ ID NO: 1799 - DNA, 676 bp, Homo sapiens
ggcacgagtgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtgctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaaaaaaaaaa

SEQ ID NO: 1800 - DNA, 1061 bp, Homo sapiens
gctgggaactgcttgccacttccttggggcctctgattttaggttctattatatcttgtttaaattcctgaggtattgtgagtcagctaaaatgttataaaccaaatcctattttcccatttacattttcaccttaagatatttcgtcttcattccaaccctctctctcaaattggtaagccttaaacacttcagcggtctgggacagtttctatttaaagaagctctttgccatctatgtatagagagcgttgaatagccattgttatgtttcagtctgtctctctcacatatttacattttaaatatgggctttaaaaaatggggtgcagttttgtttcattcttctgcctttctaaatcctctccaaaattgggtggcccttcttaggttgaaagctgttttctcttgttcctttttttctcatctggattgcagatacatttcactagcaccatttctccttacttgggccttacgagggccttagccaaattccagcccgtgcctccctctaccagtggtgggcacaccatctgcgacattctcctccatcttccttttgtgagataagaaggtagaattccatatgacataagaattccacggctttcacctcctaaatgctcatctgtctttcctcctccctgcaaatgttgactttcaatggctttcaatcttcttttctcagtcactacttttttttttttttttgagacgaagtccagcctgggtggcagagtgaggctccatctcaaaaaaaaaaaaaaaaaaaaaaaaaagcactttgggaggccgaggtgggcgaatcacggggtcgggagatcgagaccatcctggctaacacggtgaaaccccatctctactaaagatacagaaggttggccgggcgtggtggcgggcgcctgtggtcccagctgtttgggaggctgaggcaggggaatggcgtggacccggggggcggagcttgcagtgagccgagatcctgccmctgcmctccagcctgggtgacagggtgacagagcgggactccatctcaaaaaaaaaaaaaaaaaactcga

SEQ ID NO: 1801 - DNA, 2046 bp, Homo sapiens
  misc_feature (63)..(63): n equals a,t,g, or c
  misc_feature (1670)..(1670): n equals a,t,g, or c
catgtgaccctctgactcaggttttgtgttcttctagtggaagragcctgggagagccaggcntcccsggactgctagcctgcttttcctggggtccctggagccggagaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagytgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcaccctggcatctagtgggcatcccacaatgtgcagaacagtctctgacagcaaagaattggtccattcaatgccaattgtagtacctttgagacattctggctgagcaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgtgcctactatttgctcggtgccctgcaaggtgctgcctaactttgatttgttatttcaasctmtnctcccataatagggagtctaatccctattccttccctgcctgatgaggatgktgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggaaaaaaaaaaaaaaaaaaaaaaaaaaaaaaaaaaaaaaaaaaaaaaaaaaaaaaaactcga

SEQ ID NO: 1802 - DNA, 577 bp, Homo sapiens
aggttatgcctctatcccttttttttccttagtttttatgttgaagaacccagggagagttaaccaaagtttgaattttactgattgtacactcatgttgcatctttcttcattccttgtatattttgcaaattggttactgaactcagagacttggtcagactctggttcggtctctttagcaatactgtaggcagtgttgtgttctttcatggggaggcagaagtctggttttctcttttttttaaatcatgtccgcagttgttgggctcagtgcccagatccattaatttatcaatggtttaaaaatagtgacattctaattgtgtgggtttttttaaaattttttgttggaatacttttattaagagatgcttctgcttacctgctgttcagttatccagtggcacagttatataggaaaggtaggatatatacttgattctttgcctttatttattcttttttcaaaatagtgacttagttccctattattctctaagagaaccagctatttaatttaatttaattaattaatttttttgagaccctgactcttaaaaaaaaaaaaaaaaaa

SEQ ID NO: 1803 - DNA, 2108 bp, Homo sapiens
  misc_feature (5)..(5): n equals a,t,g, or c
  misc_feature (34)..(34): n equals a,t,g, or c
  misc_feature (41)..(41): n equals a,t,g, or c
  misc_feature (2045)..(2045): n equals a,t,g, or c
  misc_feature (2075)..(2075): n equals a,t,g, or c
atccntaatccggcacttgtagaagtcctccatngagttgnccaagttcctagattagatttggttagcacctttgcagacttcaggcctgatgtgtgtttttcttagtacaccatatcaggaggcacagatatggatcagttctattactggttatgttaacttcagcttggttaagatggtgtctgccaggtgtctccattgtaagttattcattttccctttacaattaataagatcttgtrgggwagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggaygttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgtgtgtgtgatatataaaataaaaaamtycttctacttgtactttggcattcaatttttagaaattcagtctcaaatgccattatggtatttttcaaatgatacctttaagtcaatggtttctttcgactgcaatagagaagatatggcaagaaaaatgttgcagtaccatcttctgggagaacattcatgaaatccttcagttntagttccacagcaacaattgacaatgtttnttttaatgatgacaggtagagttgatacttctc

SEQ ID NO: 1804 - DNA, 1026 bp, Homo sapiens
  misc_feature (971)..(971): n equals a,t,g, or c
  misc_feature (1003)..(1004): n equals a,t,g, or c
  misc_feature (1007)..(1007): n equals a,t,g, or c
ttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtggtcccagctactcaggctcctgagtaacttggattgcaggcacatgccaccaggcccagctgattttttcaaattgtctcactatgttgcccaggctggtctcaacttctgggctcaagtgatacttccaccttagcctcctattagtttttcccttacagcaattcctgcaatatataaaaggtctttacttcaagtgagctgtgaatgcaccactgcaatntccagcttggcagaggatgacagagaccctgnnttncaaaaaaaaaaaaaaaaaa

SEQ ID NO: 1805 - DNA, 1103 bp, Homo sapiens
ggcacgagtgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaaaaaaaaaaaaaaaa

SEQ ID NO: 1806 - DNA, 1421 bp, Homo sapiens
  misc_feature (1267)..(1267): n equals a,t,g, or c
  misc_feature (1297)..(1297): n equals a,t,g, or c
gcacctgactgcccacacagatggaaaggtggcaatgaggaaggcagaagttgggcctcatcaggtgtgtccaccatatgggcacaggaagcacaagagagggcaggccctcctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacactgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgytattaacagcatccgaacaatcctcatcttttgaagatgccaggagcaattcggaatactatctgattgaatgtgaacctgcctggttaatttattacctgatttgatgaaccaaggaaagccatgcktttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataattttttwagattgggtaatgaatacatggagtttcattatacttttctctccacttttgtctatgttgaaaattttctgggagctaaatgatgagnacacatgggacacmtgrtgggggacaacanacactaaggcctgttgaggcagggagtcggcagagagagagcatcaggaagaatagctaatggatgctgggcttcatacctgggtgatgagatgatctgtgcagcaaagcaccatggtacatgt

SEQ ID NO: 1807 - DNA, 845 bp, Homo sapiens
gctgttttgggttccccagctacagtcggaaagacatcagagtgttcaaggcggagtccaggcctgagatctcagcaggccagacaggcagcagatgcttgttgcttttcttgtgttatatttttcgttcccttacttagcatttgtgggaccaaagccaacaaacaacaggttgttaaaagaatgagagtaatttgacttccgacagtgattggggctcggggttgttgggtgttttgttttctgatttgaaactagctgtatggtaaccactaactctcgccttattctttaatggaattttggaaaggcctcactccagtgactctttggatctttcttcyctaagtagatgggaagcctgtaagaagagacttggaggcaaagcaaagggaatcagcacttaaccctcacccaaagggcccaagagaatctttagtaactggaggcagagcagactggagcctctayggggcatctccccatattggagaattcagtctttgttttggaaatcttataatgtctttggagaggctttaaataattttgtttttcttagcaatgttatgctctattttgagacatggattttttttttcttctagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaaaaaaaaaaa

SEQ ID NO: 1808 - DNA, 1781 bp, Homo sapiens
  misc_feature (1363)..(1363): n equals a,t,g, or c
  misc_feature (1377)..(1377): n equals a,t,g, or c
gttttaatggataaatttgtgtgttgattttggaggaataaactcagaatactccctaaagatagtgaattttggtctgggtaatgaaaagtaggaatataattgattggaataatgttgtcatatgttgttttaatgtttatcttaaaattagtaacttttccaaggaaaattttatttgatagcataacttctctggatattattttaaatcagtctggtaaagagaaaaaatacagaaagtattataatttgtgttttcatcataaaatattttgcatcagtatcttattgcagtacggtaggagactatgagaaatattttgaatcttaaaagtaccagataaagacacaataactaatgattttgtctttaggagggccagaactaattgatcctgctggtctgccattacctcagccagctcagtcctgggtatggcttgtggatctagaaagamcaattgctctccttattgggcggtgtcttggtggcatgcttcagggctcccctgtgtctccagaggaacaggacactgcatattggatgaaaacgccactgttcagtgacggtgtagaaatggacactcctcaattgggtaatgtgcttctctgcagcatttaaaatacatgcctgtttgtacctcagttggagatttctctattctgatttgctaaatagagaactgacaggcaccaattgcaacattagcagtgtagggaatctggggctatgacttggagccctaagaaaaatggttaaatcgtgcagcacaatatggtgaaaagagcccccagaggaaatagaaattgtaggtctggtcctactctgtcatatttatcactcattttgagcaagtcatctaactcaatgcttcatcacttattttccgaggcttggaggttatgaaactgcttcccagaatgtaaagcactgtaagagtacttmaccatgacttatcagtgcmgcacccctgagatgtgagtggcagcctcttttcctcccagcctgtcttgctttcatgctgacattatattatgtcctaattttttcttcgccacttaaagtgcctttagaatttcccttctgcagcatctcccatttgtatatattgstggcaggctagwwcctagactgarcatgaagacttatctggtaccccagataatccagttgktttatctagaattggtcctttaatctctctaggcttctaawtttgattctataaaataatgatttggattagacaggctacatgatattattagatctaaaatttattatttctctgataagacaaagagactcaacatgtccctgaaggaaagtctaagagagactgagaggaaagaaggagancggaaaagaaaagnaaaaacaaaacaaaatgagaaagattatactttgggatttggagggttggagagtgggagtgagggaagcagttgaggattttcctccatttccaaatatgagtgtacattcatcatttcatttatgaaccagaaagtgattttggccatggctggtgaatgttggactggtgtttatgaaacattttgttaaagaaagtaaaatcatggtttttcaaggggtytttaacatgataaagataattccactgctgtcagtgtttaaccttgtgacagtcctaaaggacctcctgagaacaaaagtatctctatctctaccctcttcatatttctgttatatttattcaattaaactggcctttaatatgaagaaaaaaaaaaaaaaaaaaaaaaaaaaactcgag

SEQ ID NO: 1809 - DNA, 919 bp, Homo sapiens
  misc_feature (11)..(11): n equals a,t,g, or c
ttacttaattntactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaaaaaaaaaaaaaaaaaatccaagggggg

SEQ ID NO: 1810 - DNA, 495 bp, Homo sapiens
ccacgcgtccggtagatcttaactgtactcacccctccaatacacaccatacatgcacaaaatggtaactgtgtgtggtaatggctgtgtaatctgtggtaatcacaaattaatgtatatcaaatcaccatgttgtgcatgtttaatatatgtaatttttatttgtcaattatgcctcaccaaagcttgtgggtggggggaataatgaactctgatgtaaggtatggcctctgggttatgatgtgtaaatgcaggctcatcagtcccacaaatgtcccactctgggggaatgtgagaatggagactgtgcatgtgtgggggcatggggtatatgggaactgtaacttcccttccattttctgtgaagttaaaactgcttttttaaaagtctgtttaaaaaataaaaataaaatgaagaatgatgaccgtgctgaaaaaaaaaaaaaaaaaaaaaaaaaaaaaaaaaaaaaaaaaaaaaaaaaaaaaaaaaaaaaa

SEQ ID NO: 1811 - DNA, 1483 bp, Homo sapiens
  misc_feature (508)..(508): n equals a,t,g, or c
  misc_feature (711)..(711): n equals a,t,g, or c
  misc_feature (1021)..(1021): n equals a,t,g, or c
gaattcggcacgagcaaacacagtttcacactgattcttaacattttgttcaacttttactcagagggcaggctgagccagggagcaaaaaggcaaaggactcctactcacatacccacttagcaaaaccaaagcaccttgggctttgaacccacccttcttagaaggcaggtttgggggttgaggccccttgagaagctcacttcaccctctccccatgccatcccattcctacccatcccaagatgcttctcttgtatttctttcagcacatccagccatctccctggggagcgtttcatatctgactctttatacttccagtgatgttttggcatccctaatagactggctcccaaggcagtctttaatcaggagtcttcccctaatctagctcctcaagaacccaagggaagaggcacaaagagaagtatgaataggaagatagaagggtaacccagtcagagagggagtggcagatgacactgctgaaaaggagtttccaganagttgcacaccatgagccacgctgtctgtccctgaccacaacctccactggccaccacctcctgggcttcccctccctccacccacagaaaccattgctcaatctcaactggactcttgmaggcctatytctmcctccaaacagagaytcctggacacagagctgcagacctctaaccactcctggaacataaaaaaaaccanggtggttctacagcatttacacctccagtttccctcagacagaatccagaagagaagaacctcgctgatctctgagcggagcatgtctccaagctcaggccagccccaaaactccaatggcctcaactggagtggaaatccctcaaaggcacaaacccagttcctaccatctccctcagtgcctggcaatgtttgtggttggttgagtgagttaacaggagaccatcttttggccttttttctacctctgttttctcttactatacttgcctacatctcatcttctggtcaacaccaggtactcaccccntgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaatwacagactcatccacactatgaggctgtgcataaggtcatgtatgtaaaactacttgctttgttgatcattctgtcccagataagtatgaattattatgcatcatttcattaaacaagaaagcttcactgtgttaatatgcacaagtaaaaaaaaaaaaaaaaaaaactcga

SEQ ID NO: 1812 - DNA, 1332 bp, Homo sapiens
ggcacgagaaaaaacattaagacagaacttaaaaacaatagattgactataatccaaagacgagtgtacctctaaccacaattttcatttatttttaaatgtttccttcatggcctttcttgtggctcaccctatgcagtttgtgtatttgttgacaactttatgtgtttttaatatggtttttgccaaacttggtttttccgagaccgtcttttctcagaggctcagttttaccgtcctatctgcagtcggctactttcagtgggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcctggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaaaaaaaaaaaaaaaaa

SEQ ID NO: 1813 - DNA, 1676 bp, Homo sapiens
  misc_feature (1669)..(1669): n equals a,t,g, or c
tattaagattgacaggtttttscacatttttggaaatgtttaatttgtacactgatttactactctraccaataattgttgatgagtgtatgagcatcatgaatgcgtgcattgaactactgtctgtgtctttatgttttaacttctttcaagatgtagccatcagttactgcactgctattactgacttaaatggacctttttscttttacaaactatacttatctatggttctttgttgaagaactcaggagttcgacattaatagaaattagaaaattttataatgtattataaaatccattactaagttgaaagtatgcttttaactctgtgtatcaggggatgtatgtttgtgtggagatgtttttttctgtctgtaggcacatgtatatatcccagtaagttcttattttcatttcatttctacatttttatgaacttgttttataagggtactgtttagttgtgataattaaatatatataaaagctttctgagagattatttactatatgaatatattttcagctggctgatcaaaagtatttttaaaattttgyttttagccattcaaaatgtatttgtattttcagaattgaatgcaagtcatacttagagctcaattaaaatactcttgcaagaaaaagcattaaattctctttgagaattccgtgaaatgcaaattaagggaaaaataggttttaagcagtagcaaaaacacaccgctaaaaatggcctttgaattctcagagctatggaaaaatgtgagaaactaaattgtctcgagatgtcaagatttttctatctccagttgctattggcctgtcctactgttgtctttgaatatttcctgtattccaccccaaaagatttcaacttttagtttttctatcactgggcaaggtcagactgggtttataaaacaatatattggcatattgtgattctttgtaattgactataaattggttttgaaatgtccaaacatacgttgtgtgtctttatattgtactgtgtgttttaagtaactggcagaaaaagaattggaaatgaaatttccaatcagacaatgtagtattaaagaaaactttgttttaaatatgcggtaccatgtaaaattactcgtgttaggaataaagtccactgttgaagttgaatgtcactaagcttattatgttaaaaggaaccagtgtgattaggaaaacctaccagaagccagatacagtgtggtacgtgcaacatttcatgcacattttgattttgtttgtcattcaaaattgtgcttgtaaaaatgtatacaatttctgagttttataatttctaggtacttgttttttcttgctggtaaatagcttttttttaaaaaaaaatctaatataaaagaaaccatgtttatattttgttagtgatcaatgactttgtttatatggaaatttgtatattgttggcacacattttgttgaggtttacgtgcatgaaggcctgcaataattagcacaatgaaaactgctttttcttacatgttcatttttttgaaagattgtggtgcaaaggcttactctaataagtaaccttctggactatggaatgaatataaatgaatggcactttgagtgttaataaagctaatatttatttccacaaaaaaaaaaaaaaaaaaaaaaanaaaaaaa

SEQ ID NO: 1814 - DNA, 947 bp, Homo sapiens
ctgcaggaattcggcacgaggaagctttgataacataaattgcttgcctgccatttaacaatttttgaaatgaattattgtctaaatagtttcaatatatgttttattttatgaatttaacaaaattcttttttcttgatttagctaattttaatagagtgttttcttatcaaacatttacttatcttctaaaactccattcttgcaaactgtttggagggatttgtttttatttttattttgtagtatagctcatgtatctagaataacttgttatgtttattatttcatcatcataaattggcttatatttcatatgcttgcagacatatagaataatcgaaaacaacaaaattatatgtatatacatatgcatacacacatatgtaaaatgtgaatgttttttatgttttgccttttattacacgttctgccttttattacatgttttgccttttattaaatctcactttgctcttcctcattcttttcggggagacatactttttcttttaaattctactactggctccttacaaaattaactatcctttaaagtttatttattaaatttatagagtcaagtttgaaaaattgttttatttcatcctttatgcaacaaggtatttattatacttttatttttcatcatctgtgaatatttagagccaaatttttatggtctttgtggttttattcttgctatattatctctgtctggaatatttatttatgtatatatttattaaataagatttacataaaaggttgagccatttattttagaattaattcaaagctctttggatgtaattttattctaaggctttgttattcttaagttcttaattttaattcctatcactgtgatttagaataaagtgatatttcttcaataattgaaaaaaaaaaaaaaaaaaaaaaaaaaaaaaaaaaaaaaactcgag

SEQ ID NO: 1815 - DNA, 1744 bp, Homo sapiens
ggcacgaggtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagactttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaraaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactawccaaggtggcacctcttctgcaatgtttaaccctgctagtaatgaacgatgacttagttcggatatwwcagaactttttgtttataccatcaggtatgcatgaatttataatctgaaagaggacttaaaataataattaaaasttaccagcttaaaaaaaaaaaaaaaaaactcga

SEQ ID NO: 1816 - DNA, 1744 bp, Homo sapiens
ggcacgaggtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagactttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactawccaaggtggcacctcttctgcaatgtttaaccctgctagtaatgaacgatgacttagttcggatatwwcagaactttttgtttataccatcaggtatgcatgaatttataatctgaaagaggacttaaaataataattaaaasttaccagcttaaaaaaaaaaaaaaaaaactcga

SEQ ID NO: 1817 - DNA, 1982 bp, Homo sapiens
ggcacgagccgaggagcgcttccgccctcagtggagcctgagagacactctcgtaagtacatgcaaactaaagaaagtgaaattcttcctgaaatggcatctcagttcccagaagcgatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattatgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgtacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaaaaaaaaaaaaaaaaaaaaaaaaaaaaaaaaaaaaaaaaaa

SEQ ID NO: 1818 - DNA, 2689 bp, Homo sapiens
  misc_feature (2316)..(2316): n equals a,t,g, or c
aaaatgtcactagttccgaagctgagaaatagttacatatgtgtcatttctcactgagtgctctcaagagttttgtctttaattctctgaaatttggatttgatattctagacatggatttcattgcatttattctatttgggtttcattcatcttcttgaatgtgtaggtttacatcttttgccaaagttgggtagttttaaggccttctttcttcaaatatatttttagctctgctccttttctgtttctgggactctgatatgaatgttggatcttttgttattatccctatggcccatgggcttccattctttttttcccccaattggattgtatgtctggtctagaatggataatttctattgatgaatgttcaagtttattatttcctctgccatctccattctgttattgagccaatccagtaatttttaaaaatttacttgttgaatttttcatctccatttttttctatttggttctttgttatatcttctatttctttacttagtgccccctcctttaatttgatttaagagtgtttgcaattgcttggtgcattttaatgataggtctcttaaactcattgtcagtgaattattaatggcaaaaactgaaattacttttgcaccaaccaaatacagtatcagtgtaatcttggtgttggtatctgttctctttttctattaggtttagatttgcctggttttggtataatgaatatttttaattgtatccttgatattttgagtattaggttatgaggcccaggtttctattcattttgtgtttaactttttaagaaactgccacactgtttcccaaaagtaattgtaccattttaatttccaccagcagtatgagcttcacctgcttcttatcttcactaacacttgctatacttagctttttaagtgctagccattatattaggcacatagtgttaacttattgtgttttaatttgcatttcacttgtgactaatcatatgtttatttgacatctgtatatcttctttgggttgttgaattttaaggtctttttatattcaagtctttgtcagatatatataagattagaaaatattttctcccagtctgtggctaatcttttccttctcttccccaaagtccggttaagagcaaaagcttttcaattttgatgactaattaatttatttgttaaggacttgcagtttcagtaacatatataagaaatttttgcctactccaaggttctgaaagttttatagttttaagcatatgatacatttttagttaactttttttttttttaagacagaatctcactctgtcacccaggctggagtgcagtggcgcgacctctgctcactgcaacctctgccttccaggttcaagagattctcctgcctcggcctcccaagtagcggggactacaagcttgcaccaccatgtccagctaatttttctttttttgtattttcagtagagatgaagtttcaccatgttggccaggctggtcacaaaccagccagcctcagctgatctgccagcctcagccccccaaaatgctggaattacaggtgtgtaccaccattcccagcatttagttaacgttttttgtaggtgctttgagctataaatcaatgtaaatttttaaacatatatataacaagttcttctagcattgtttgttaaaaagattacctcttctttaataaatttcctttgcaccactgtcacaaatcagttgtccatgtatgtgtgtttctcaactctctattttattccatgaataccacacagtcttgattactgtagctttataataagtcttaaattcaggtaacatatgttctccaactttttctttttttttttgagtcggagtctccctctgtcatccagactagagtgcaatggcgtgatctcggctcacttcaacctccgactcccaggttcaagcaattctccctgcctcagcttcccaagtagctggaatttcaggtgcctgccagcagacctggctatttttgtattttttagtagagatgggttttgccatgttggctggtcttgaactcctgacctcaggtgatctgtccaccgcagcctaccaaagtgctgggattacaggcatgagccatcgcgcccagcctattttccaactttcagaattatttttaaaagttggtttcactaatctaggtcctttgcatgtccatatgtattttagaattgagttcccaatttgtacaaaacaaaaagcctcctgaatattcaaaatgggatttcactgaaggcctaggtcaggttggaaagaattgacatnattaaatggtattgagtcttgtagtctctgaacatagtatatctctatttaggtcttttttaaagttctcccagaagtgtttttaatttttatactatacatcttgcacttcttttgccagatgcatcactatgtatttcatattgtttatggtgttataaatggcatttaaggttttaaggttcagattgttcatggctagttcatgcaaaatcatctgctttatatatattgatctttattttgccagtctcactaagctcatttagttctaatagtgttgtagataccttcagattttttttatatagacaatcatataatctgttaataaagatgattttacttcctttccaaaaaaaaaaaaaaaaaa

SEQ ID NO: 1819 - DNA, 1573 bp, Homo sapiens
tcacggctgcggaagacgaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccamgamtatcgccatggcagccytgatcgcagagaacttccgcttcctgtcacttttcttcaagagcaaggatgtgatgattttcaacggcctggtggcactgggcacggtgggcagccaggagctgttctctgtggtggccttccactgcccckgytcgccggcccggaaytacctgtamgggctggcggccatcggcgtgcccgccctggtgctcttcatcattggcatcatcctcaacaaccacacctggaacctcgtggccgagtgccagcaccggaggaccaagaactgytcsgccggccccaaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcagtcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactrcttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcasctctggccttattttatatatttaaatttttgataaagtttttcttactaaaaggacaaaaaaaaaaaaaaaaaaactcga

SEQ ID NO: 1820 - DNA, 1986 bp, Homo sapiens
cggcacgagcggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatctagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcgtgttatgaattactagctgattacagttcagagcattgatcctggaatgtgtgctggagaaatttaaaatactggggttttttgtttatggtgcctatttagagttggaagttgaacagctgttgcattacatacttttgcttttttattgaaattttgaaatcaaacgtcttgaattttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccaaaaaaaaaaaaaaaaaaaaaaaaaaaaaaaaaaaaaaa

SEQ ID NO: 1821 - DNA, 1993 bp, Homo sapiens
ggcacgagcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaatatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagccggggcaatgtagggagaccctgtccctacaaaaaatacaaaaattagccagtgtggtggcttgcacctctggtctcagctacttgggatgctaggcaggagattacttgagccccaaagttgaggttgcagtgaaccatgatcacaccactgcattctatcctgggtgacagatgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaaaaaaaaaaaaaaaaaa

SEQ ID NO: 1822 - DNA, 1469 bp, Homo sapiens
  misc_feature (1419)..(1419): n equals a,t,g, or c
ggcacgagcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctatcctcagtgtgtatatgacagccagtataatcaataccctaggttatgcgtctatatgatactcatctgtgaatattattggttttgtaatctttgttatataagaaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttattttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccagaaaaaaaaaaaaaaaaaaaaaaaaaaaaaaaaaaaaaaaaaaaaaaaaaaaaaaaaaaaaaaaaaaaaaaaaaaamnaaaaaaaaaaaaacaaaaaaaaaaaaaaaaaaaaaaaaaaaaaaaaaaaa

SEQ ID NO: 1823 - DNA, 1254 bp, Homo sapiens
  misc_feature (441)..(441): n equals a,t,g, or c
gaattcggcacgaggttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgargtctctcttgctyccctcctgcaggagcttgcagtccccccaggagcagatcatcttggcgccgtccctggctaaggttgacatggagatgactcagctcamccaggagaatgcagacttcgccactcgggatngctaccamcactyctccctcgtgaaccgggagcagctgatgcctcactactagatgcagtgctgggaccttcctcttttggagctgtcccatgtacagtggacccaagcycaggaccttcgtggagctgcttctccaacctgagaaactcaagacccatcckcccgytgtcactttggacaatggamatctacattttcttttcccttttttttttttttgagacagagtctcgccttgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaagtctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaaaaaaaaaaaaaaaaaaaaactcga

SEQ ID NO: 1824 - DNA, 1827 bp, Homo sapiens
ggcacgagggaaactggtattaggaaaaaaaggatgataatcaataagcaaatgattaaagtagaactattaaccttacataaggttattgtaaatatgtaaagaaaagagaattttgaagtttaaatttagtagtagcaatagacctgcaatgtaaagtctaataattattgtagaaaaataattctctgaggtttttctttctccagatataatttttttatcatcttatatcctgttggagttgctggtgaacttcttacaatatacgctgccttgccgtatgtgcaagaaaacaggaatgttttcaataagacttcctaacaaatacaatgtctcttttgactactattattttctcttataaccatggcatcatatatacctttgtttccacaactctaattttcaataagttacgtcaaaggaagaaaggtgcttccatggagagtggattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaacttgttaataatgtattggtatttttgaacccacaatctattttttcaggaaataaggcagcattatgactaataacagtgtttggaagcgtggatataatttgctaaagtaagacttttgatgtagataaagtagcagcataaaaacacacaaatattcaagtagatgtcacagttggaaaatattctttggaaatatttctaggcagctgaaattacttatactgctaaggaaatctgctttttatttaaattagccacttaaggacaaggttttcaactgtgaaggttttaaggggttaggaagagcataagtatttgccccactattaaaaaaaaaaacatgacatctgactataatgttgtattcaggctgggagtggtagctcatgcctgtaatcccagcactttggaagactgaggcaggaggatcgtttgagcccagaagttcaaggccagtctgggcaacatagcaagaccccatccctaaaaaaattacaaacaaaaaaaattaaccaggcatggtgacacatgcctgtagttccagctgcttgggaggctgaggtgggaggatcacttgagcccaggaattcaaggttacaatgagctatgatggtaccactgtacttaagcctgggtgacagagcaagaccctgtctctgaaaaatagtgatgatgatgatgatgatgataacgatgatgaggaaggtgatcatgctgtactcagaactttggttgagaaagtcttctctatactgtagaattatcttgtaacaattgttatgataatccctttgtggtacttaggtaactaaacattttggggtatgatctttggacagactcctttcattctgaattccattgaatagcaaaaggtcttgtaataaagttcctgtccttgtgtttaataaaaaaaatacaccagaaaaaaaaaaaaaaaaaaa

SEQ ID NO: 1825 - DNA, 1514 bp, Homo sapiens
aattcggcacgagcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgtggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacaaaaaaaaaaaaaaaaactcgaggggg

SEQ ID NO: 1826 - DNA, 1535 bp, Homo sapiens
  misc_feature (574)..(574): n equals a,t,g, or c
ggcacaggcaaaattgccttcaaaggctaagtctcttgtattctgcccttactgagagtctgtactctcctaaggttaattggcttatcatattctgcttttgtgctccctagtttaccatgatgcttggggtttttgcccctacgcttttcactttgtcttcctgtaatttattacaaccaacccttgtgtttttttttttttaacagttttggatctgcattaattttttagtccccagaggaacactatgttcccaaacattatgttctgcactctcatgctcatatcactttgtgtagtgccagacacctcctgggatctcaagaaatgttgtttctttttaaaagatgggtgattactctaggaggctcataaaagatctttctcagttgagttactttcactgtttatgtatcccaagtggcttaggtcaaaatattggttaatagaaagactccaagtctttggagaagctttactagtgtctcctcatctctgtaaaagcaaagatgagtattgaatggtcttacaggagtgttggagagaaatgatgaaaagcattagaaatganaaggcctttgttgaaaatatgaaatgccagagtgaagacagtatcattattcccaagcaggcctcagtgtaagcggagctctctccaccaattgaagctgttcatcactacaaagaatggctgtcctgcaggatcctttctgctgctggctcctactgcagagaatagaaacttctttctaaatactgtatccaaaatgtttcctcttctctcaacttctcagctctatccaggacacttcactgctttcctccaaggcaaacttgaaccttcctctaaattccttccctgaaggctgttttgaggcagagggataggaccatggacagaggcttagcctaccaatcactcacacagcaggaaagtcaattctcttcctaccaggaatccctgggagagggtgtttacatgaatagactcttctttaactataggtcacttttcccttstctaamttcctttggagtgatgctgtgtcttctagaaacactgactccttccagcaactctctgctccttagacatataagaaatactcattcttgcaaatgcagttcttaaaatatttcaaaacatcttcattataaaatatttcaggcaaacagaaaactatgaaaaatagtttaacaaacatctatgtgtaaaacagctaccttagctgggcgcagtgctcacgcctgtaatcccagcactttgggaggccgaggagggtggatcacctgaggttgggagttcgagaccagcctgaccaacatggagaaaccccatctctactaaaaatacaaaattggccgggcatgatggtgcatgcctgtagtcccagctactcctgaggctgaggcaggagaattgctggaacccgggaggcggaggttgcggtgagccgagatcgcaccattgtactccagcctgggcaacaagagcaaaactccgtctcaaaaaaaaaaaaaaaaaactcgag

SEQ ID NO: 1827 - DNA, 3051 bp, Homo sapiens
ggcacgagctgtctcagcctcccaagtatctgggattacaggcatgcaccaccatgcctggctaattttgtatttttagtagagacggggtttcttcatgttggtcaggctggtatcaaactcccaacctcaggtgatccgcctgccttggcctccaaagtgttgggattataggcgtgagcactgcgcccgctatccacatccttctagagtcagaatggtagggtccgttgacttcagcttttgattttgcaggatggccctgtgtcctcctctgccccattccctggttcattaaccagtttgaagtgtatgtagattgttgccccgtctttcccaggtcacatgtgtgagatgcctgggtgctgcttcagaaatcaagatgatctcctttaattgcatgaaactacaccatgctgcgttccccaggcagacagttctgctttgacacaccaaagaatcccgtaggctagcagagccgccagcacaaaccaagggcgctgggtgtcgagactcagaggggtcagctgtgtccctcggcatcagcgtctaccaaggtgctgctaggtacagagccagccagtgttgggcagcaggctcacagcctcaatagggagaaaagacaaaggcctcaaaatgacaggcagcctgacagaggaaggagtctgacacctcagcttgatgcgtctttggaattcctagctcatctcagaattatatcttagagtgataatatgggtggtagccagtggccaaacagcaagaactaagagtggcccttgcaaaaaaaggttgggaaagctgggcccatattgcctgtaaacccttgagcctgatgctcatacagctgtcccttgttttagccaggtcttgacagaagggttaccagcactgtcactgctctacagaatgctctccccgtgcctctctgttgatttataacagttgggtaaccagatagcaatatagtggcaattgagtagccatatagtaatacaggggcagttggttaaacatatagcaatatcacataatgatatgtttaatttaacctcagttttttaaaccagaatgcttctaccataaaagaattgtgatttcagttrtacttccatcaaggaatatgtgggaagatatacatattgtcaaaatggttgggatgggatagttacaaaggacacttttgtatgttgtatgggatcacttgcctgatagtataaggaacattgtatgaaaagatgaaaagatacttcatttttagaaactgatcagagatgtcactggtctttaagtgatgtcttgaaaatccagtatgtatttgcccaaaagttttagcctacatctagctagcttacacttagcagccaaaccatcattgtgtaggttctgttttggaggaagctcatgggggatctgtgtatttcttaggtttctccctgttctccaatgttttatccatttcgtagcttttttactgtctccagaaagtagtgtgggacctgcacttaggggaataccagaatcatagcgtggttctgccttcttgatgagtgattgtgaaaamcacctgcataagggtgctaattggttgtgyattttttcatttatttgaaatcaaactgagamcacctcttttcggtttacagcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttagatgttttctcacttttgtgacattaatttatcactgagtctcattcaaccaagtaatctaaaatactgtgcaaattctagcagtatgtcttcgataacttggatgttaggatagccaatatgtacaaaaaattaaatcaagtattttgtcctatgtataacacaaattaattttacacagagaaagatgtttctaggcaagtgaaattctggtaattcatactatttctttgtatgaacaaataaaatatattttgccaacg

SEQ ID NO: 1828 - DNA, 1290 bp, Homo sapiens
gaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaaaaaaaaaaaaaaaaa

SEQ ID NO: 1829 - DNA, 1503 bp, Homo sapiens
  misc_feature (1061)..(1061): n equals a,t,g, or c
gtaattcggcacgagttacaatcccaggatggtgcaaattctgaagagaggttgcaagatacatgagcaacttaagcagagaaacagttttactaatatctagatgtgctatgattgtctgaaatggcacagaaagaaagcctagagaagtaaacaaagcaaacaaaataaaaattacaatcaatgaaaaggatcttaggttttaattctccaagttgtgtactggagagtagccgcactgaggggatagaatgttctcctaatttgattatataatcactcttgtccattactactacttttccttccttctcacttgaaaaatctgacactgctctaatttcatgctttccctgaataggcaccaactgcccataaatttttagtcaattacacagaaacctttgactcttgggggctgtatttgtgatggtatttgcttaagagttttatttctaaggtagttatttatctaagtcttgattcttataatattataatcattaattccctttkttttaggstcaacatctctacccacattatcatgtttcttgatcacaactaggttacaagggttggagatacacaaagatgaatgccatactatttatgcttataaaaaagcaatttatcttttgttctactacagaaaatccttcctcaaaaacaaattcatgaagtcagccttgctcaaacaccttcagtggctctttatttctggacataaatctaaattcctttgtcaacattttgagatcttcaataacctggtttcagtcttccaatttaatcttaaatatgttctactgaatgaaccaagtgcttaaacaatttttattatgtgggtgctttgaaaatgttgccagaatcatttaaaaggttctgggagaatatctcacctgaaggaaatggctctgctgatgcaagcagcacattttctggctttaaatcacagtgcacaatattcttaaaatgcagattccycaagcaacaagtatctgttatgaaaaagatttycttttcatgtctggaaatcacagtaaacctcctgtgactcntgaatgatttaatttgaaaactccactatagttcatcaagacttagctaaaagtgtgttattctgctccttaaggttaacaattcccacaatcacccaacatgtaaargtactgctatttaattattttagtttttagckggatacagtggctcatgcctgtaatcccagcactttgggagacctaggcaggtggatcacttgaggcaaggagttcgagaccagcctggccaacacggtgaaaccccagctctactaaaaatacaaaaattagccaggcgtggtggcacacatctgcaatcctagatacttgggaggctgaggcatgagaatcacttgaatccaggaggcagaggttgcagtgagccagattgcaccactgcactccagcccaggtgacagagtaagactcttgtcttaaaaaaaaaaaaaaaaaaactcga

SEQ ID NO: 1830 - DNA, 2289 bp, Homo sapiens
cacgcgtccgcggacgcgtgggcaacaacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggaggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgcaagtttccaagaccacggggaggtaatgagattccatttgtgagtgaaaagaccatatatggtaccttctcccggatgggaacataaaggaaaaacaactgcctgatctgggaaggtgacagtactaccttcttctagaaaacaaagattgttcaaccaccaccatgagaacaggtggaaaatatctctatagacccaacctggcaatgaagtataacatcccacccccaggcttctcttggtgccctagttgggttcatttttgtttgtgactatgaatgggaagaagtcacaccctgtaccactccaactccctaaggagtcacctcttctttaaggaatactttcccttgtatctaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaatcaagagttccccagactctggaaaatgtagttgcgataacagactaccattggattattaactagctgaacaaggaggggtcttggcagttattaataaaactgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtagtaggtgggcctcacctctggaagtggggctcaggcactcagaccaactgagcactacctaaataggtccagggcagatgctagttccataggacacaccgacctgtgtcaagtcagttcccatggctctggcagcacccagaagttaccaccctcaccctggaaatgtctgcataaactgccccttcatttgcatataattaaaagtggatacaaataccacttcagaactgcctctgatgctactgtgggcgcacaacctgtagggcagccctgctttgcaaggagcagcgctctgctgctgctgtgcacagccggccgcttcaataaaagttgctaaccccaaaaaaaaaaaaaaaaaaaaaaaaaaaaaaaaaaa

SEQ ID NO: 1831 - DNA, 2929 bp, Homo sapiens
ccacgcgtccgatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcatgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacaatcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtgtcttgtgggaaacctgaaagtccagaacatggatttgtggttggdagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcaaaaaaaaaa

SEQ ID NO: 1832 - DNA, 1203 bp, Homo sapiens
ccacgcgtccgcgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgatgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaaaaaaaaaaaaaaaaaaaaaaaaaaaaaaaaaaaaaaaaaaaa

SEQ ID NO: 1833 - DNA, 3186 bp, Homo sapiens
ccacgcgtccgcccacgcgtccgcccacgcgtccgcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctagctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggacttcagcaacttcctgtgacctcccagagttcttgcacaggggccagccctcacttgccagccaatgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccctctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtggggaagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaaaaaaaaaaaaaa

SEQ ID NO: 1834 - DNA, 1608 bp, Homo sapiens
ccacgcgtccgcaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaagccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacacactgtctgggttaagtgcccagtgaggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgcatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtcaaaaaaaaaaaaaaaaaaaaaaaaaaaaaaaaaaaa

SEQ ID NO: 1835 - DNA, 1218 bp, Homo sapiens
ccacgcgtccgatcgtcatttcttcatagtaaccctgactcaaggggttttggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagggtcaggttgggtaggagagaggagagtcttggaggggctgctccatgggggtcacacctctctcctgtgggttttcgctggtgattgagttctgaggcatttgctgcattgactgttgtagctttaactcgtgtgcacgtgtgacacataaagccccaagagaagggctgcctggctcagatgcacttccatgctgattatatgcatgggtgttgaaagcagtgctggctgagcagcgatcccagtgcagtttgactttattctttgctcaaataggtgaagcccacggtcccggcctcgaaggtggtctcgtgggcaagcctgccgagttcaccatcgataccaaaggagctggtactggaggtctgggcttaacggtggaaggtccgtgcgagccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaaggtgggtttcatttaaaaaaaaaaaaaaaaaaaaaa

SEQ ID NO: 1836 - DNA, 368 bp, Homo sapiens
ccacgcgtccgaaaaggaattgcaatactatcttaaattgaaggcttttatttcaatgtccttacatttaaaatgggatcttacaagggaagtaccaaaaaagtaaagtttattttgatgactctcaagatatatatgtttgttttgaatgttggcagatgccaatagcccttaacatttgaaaaatggtacttgaacatcaattatgtctcagagttcccttaaactttttgggcttaaatatttttattcattttggtcatacctttgacaatggatatgttaaactttaacaattatagtgacaaaacagcttgcttagaacctggaaattaaaacacaatttctagagtaaaaaaaaaaaaaaa

SEQ ID NO: 1837 - DNA, 685 bp, Homo sapiens
ccgggaattttggtcatgaccttttgtgcgtgtgtgtatgtatgtgattgggttgaatttagcttaaaaaaagttatgcaagaaattcatgcttgttgtaacgtgtcaaacaatacagaggtgtagggaaaatacctagtgccaccctccactccaaaaccccatgtcgccagagataaccatttattcagacagtgagtatctattaagtatctattgctaggctttggagatagcataatgaacaaaatggatgtgctctctgcccttgtgatttggacagatgcttccagttaatcttttttctgtgttttatattgattatgtttgtatgtatgtgcgtgtgtgtgtgtgtgtgtgtgtatcgactgttttcttcctcctcccataccattccccaaaaaaggagggggtagggatcaagctacacctatttgtaacccagttttttcaattaatggctgggcatgtccttccaagtcattacatatagatctggcttatccttttcaacagctgtacccacattcttcagtgcagagagaccacgctttattccagcattcccccactgctggtcctttaggttgttcctctgagatgtcttttttttttttttgagacggagtcttgcactccagcctgggcgacagagcgagactccatctataaaaaaaaaaaaaaa

SEQ ID NO: 1838 - DNA, 781 bp, Homo sapiens
ccggtccggaattcccgggtcgacccacgcgtccggtcataattgctgccatarttcctgtttgtctatctctctctcccctaggctcagaattccttgccaacagtggctgtgtctgatatgtctttgaatcttcagtatcgaactcagtgcttggcatatttgatgttcataaaatgtctgttaaaagaataaatgaatccaggactcatgtttctaataagtatagaaattgctctcttaccccacataagtcttgcatatccttggtcattggcaatactagataaggatatgctatttaagtagcctaaacttaaacaatgataaagctacattactgcatgtttactgaatgtcaaacagacttctaagtgctttgtgtttactaactcatttaattctcacaaatttataaccatttggtaggagaggaaaccaaggcatggagaggttaagtattttgctcaaggccacacagctagtaaatggtggaactgggatttaaactccaacaatctaacttcagagcaatacagccttagtaaagcagtctcacatccatcatctgactcaattaatgtatcacaagatagtaatacctacgtatttattataatgaaagaaatcaagagccaaataaatcaagttgttagctatagtctccaaagaagggatacccaagatgcaacccttccagccacttcctgcagccatgcttggttcctgtatatgcctaaagacccctcatttaaaaaaaaaaaaaaaaaagggcggccgc

SEQ ID NO: 1839 - DNA, 829 bp, Homo sapiens
cccacgcgtccgaaaccgttttagtttaaaatagatcatttgatttaataaactattttaaaattgactgttttgtaaactgcatattcataaagtgtttatagtctgtagttaaattttatgttactgttaacgaattaatttatttaatttcttccttcatgttcctaatcattttcatttcacttaattttagtttatgtcatagtaatctgacatttactcatcagcaaattacaatgcaaaagaaaaaatatttttaagaaatattcatatttttctttatggaaataagtgtgtttaaatgcacaagataggaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataaaaaaaaaaaaaaaaaaaaa

SEQ ID NO: 1840 - DNA, 1007 bp, Homo sapiens
ccacgcgtccggaaaggtctgagcatggtgccgattaaattctccattgaaatgtacctttgtgggtacattaaattattttagcataagtctagtgaagtgccagcagtagatactatgttatttctggagctcttgatgttgatttttgaggctgaacatgctcttagcctcaagcaggtcatatttggaatacctgatgtgtgctcctggttgctcagtgcttaggatgcataaacaggtagctgcagtctcatctctcagtatatatacttttcagcaaatcttttttttctagataaattggaaaactaccttttttctgcatttttcatctgatgtcattatggtatgtaggtggcagctttcttggggcacagttgtctatataactgttcatcacatgagtcattgtctgtttctgktcttctgcctgaaaattccatcttggaaatcgtgtcatgcaatcggtgactgcgacattctacttgttatgtacactgccactggctttgtatgttatgttgatggactctacctgtgctacagtgaagggataaagtgacttattaaattgagtcagactcagttcctccaaatggtatttcctgtaaaaatgatgccaagcaagattctgcataaaacatgcatatgctttacactgtaagcatacagtgcctaccttttgttattgtctctgcttaaatccttaccacagttgtactcctgtttgatcaagtggccagtttaactagatactagctttgaagaagttctgtattggcccctggaatgtgacagttcataccacattgaaaaggtaagaaccaagtctttgtagagtagaacaccttaaagttaatccacttttaccaaattcctctattgttaaagcaacagtcctatattggctaatttttaaaatcataatgtgccacactttacacatccctagaatgtaagctagggggcaggggccaaaaaaaaaaaaaaaaaaaaaaaaaaaa

SEQ ID NO: 1841 - DNA, 854 bp, Homo sapiens
  misc_feature (345)..(345): n equals a,t,g, or c
tcgacccacgcgtccgccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttnagagtgccttggctccctcctgtcgtcctggggaacctcggccccagccctgcctccccagccagtcacagctcctccctggtcaccctgagggagctcagggcccggctggtagctgggttgctctgcttctgtccccgactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaaaaaaaaaaaaaaaaaaaaaaaaaaaaaaaaaaaaaaaaagggcggcc

SEQ ID NO: 1842 - DNA, 1274 bp, Homo sapiens
cccacgcgtccgtgcatattgaatttaactaatcattgtccttaataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtaagaactcctgtaatgcaaaccggtagtagaagtttgctgtaaaataatttgcaaattaggagagccaagaattttcctctcccacttatttcccatttccccacctgcattcaaacttaatgtgttttaattccatatggtttcagaaattcacccttcctttttaattgtaggtaatctctagcttctttattgaacatatatttactgagtacatgctttctaaactttttgctagtgcctaaggacactaaaaatcctttttcttctgtgaaagctctaatttcatagtagagtaagatacataaacagctgtttacattacagtgagctcctctattatacatcatttttcctacctgaggcattcctgtgctggtgattttatctatcgactatattggtggttcttaaccccattgtctaaatgaatagctggcttttttcccaagtatggaaatgtatctgggatttaagaaaaaaaagcctcataattaaatataactttggcccttgtgagattggctgtgttaatgtttatttctacaataaataggacctttgtgtgatgccaattaaacttcaaggttgaagatgggatattcatggtaattatgtttgtagtgaaaccagaagggatagggatacctgtattggacatagaaattttaaggtgtatgttcatcttgaggaaacacaatcaccaaaaatgctttataattaccgttcttgggagagagagtgtaagaataatgattgagctgagtgcagtggctcacacctgtaatctcattgtctcaggaggctgaggcaggaggactccttgagccctagagtttgaggttgcagtgagccatggtcatgctgctgcactccagcctgggtgacagagtgagaccttgactcaaaaaaatggccagacacaatggctcatgcctctaagctcagcactttgggaggccaaagcaggaggatcacttgaggtcatgagtttgagaccagcctgggcaacataatgagagcctgtttctacaaaaaaaaaaaaaaaaaaaa

SEQ ID NO: 1843 - DNA, 1820 bp, Homo sapiens
acgcgtccgattaaatggttattctagctcctcttaacaatgaaagtgatcactctctggaaccattggaaataggtcattatatcatatgaaatgtattcttgaattctaatgactattattttaaaagtgctcttcattcagatgacaactcagttaaaatatttttcaacaatgatgaattattttgcattaattattttttctgtttggttattggtttaacactctggagatgagcaaagaaaaaatatttaagtctgcctttcggaaaaaccattgtactctcagtgtcttccatcatttcttacctacaaatgttgttttgtttaaggaagggttcttgacatttgccgtgtaaggttatagaataaataaagagtttatttacctacggtagtggtgatttagtttatttttaattcttactgtctattataggtgtaactcattgattttagttacaagtttttaatttaaagtttctatccccaaaactattgccctcgaaagtatcaaattactataaaatatgaaaccttaaatactttgacacttatgtaaactagggtaacatcattttcattacgtatgggaaagtacatatctaaatatatttttgaccaaatatatttgtcaaatttttaggccagtttattttgtcccaatatttgagcaaagttgagtggatattaagagtgggtttcctcaaattatgaggaacaaaggcataatgcctggcacaaaggagaccctgagtgaatcacattgctttttaaaaatttgttttgatcacttaagaaaaaataagtcatgtttttggtatatgtctcaatgtaagaaataaaactttatcaaatatttgaatttactcacagctaattaggtttttaaaaagcgttaaaatttgtgacatgtatttctatcaaattgtatacacactcattttttaatttaaggaatcaaggatttatagatacagttttgttatgcatattgaacctatgaacaatagctacatttctaagtatcttttgtgaagttagttgttttaatgatactaaagatatggcacttgggcttgtctttaagaatccctccagttatgcatatttttatttataaatagacatttttctctggcaacagcttttattattctctcagaggttcacagccttccaaaatttaagaaccactgtttttttttttgttttttgttttttgtttttgagacggagttttgctcttgttgcccaggctggagtgcagtgagctgagattgccccactgcatcactccagcctgggtgacagagcgagactccatctcaaaaaaaaaaaaaaaagaaaaaatcagacctttataacaaataatgaaacatttcccaataatgaaaagcccagaaccaagctaagctggtgaattctatcaaatattaaaagaagaatgaacacaagtcattctcacatgcttccaataaatagaacactcagattcattttttgaagccagtattacactgataccaaagccaagggaaagtatcacaagaaaactacagatccaaatcctttatgactagatacaaaaatcctcaacaaaatagtgacaaactgaattcagcaggttattacaaggatttatacatcaagaccaagtgggatttatcccaggaatgcaagattgcttcaacatatgaaaatcaatatgatataccatattagaagaatgaggagacccacataatcagctcagtagatacaaaaaaaagttgcatggaacccaaaatgctttgatgatttaaaaaaaaaaaaaaa

SEQ ID NO: 1844 - DNA, 1984 bp, Homo sapiens
tccgtctttttctacattttagctcctaacaatgcagtttctatttatttgctgatttcttactattgatttgatagtctataattaacatgtatctttttaataatttttttttcagttcttggtacttaattctagtccttctaaatcagtattcaggaactattgtgggagtgtattagaaagtgcatgttcaaatgctaatcacatatccagggagactccagttctgtgttcatgcctctcagccatcaaatgacttcgggaaatattaattcccttctccaggttcaaagtcacttcaggtaaatgaaagaagaaatgtggtttttgatatcctggtgcagagtctgaagcttgatttctgtggagggtctagagatttgctaactgaaggcattatgggatagttagtgcccacttctatgtaggaaatatttttctgtctcccattgataatagtaaatacaaaggaacatcattagtttaatattatgaaacagcctgcagtttcaaaggaatcatgtttttgatttggtgagacagggctggattctctacagcctatattcatcattctgcatatcatggttgttgattattgaggattaggcctcctaatcctacagctgtgtcctaggtgcttgggacatatcattgaacataacaaaatccctgcctcatggagcttgcatcctaacagagggaaatagtaaataataaatataataaataacaaaaataaacagagtctttgaaagcagtaattctttggaaaaaagaaacgaatattgcaatattgcaatttaaggggattgatagtgtattataagttattataagttgcagaattaaatatcagagcagttattattgaaaaaaaatcgagctaatatttaagggagataaaggagtgaaccatgttagtttcggggcaaggacattccaaactgaggaaatagcaagtgtaaaggtcctagggtaagagctgccaaacatgttctgcaggtcaagcaggcataaagagggatgtaagttaatgtaatcattttatcctttctaatcttcaattgatgttagagtctttttagtgttcctaaatgtctgtacactagatcctggttggctgaattgccatctgcagtggtcctgctactggattcctctgacctttggtcattcttccctttaaaccttttacattttgacacttcattattttatgctgcttattcaaaatgtatactttcttttaacgttattctttctttagtctctttacttcacttggagtcagattctactagaatcttttttgaccccaaaagcatttggaaacacatgaaatatttgggggaaagggagttgtcatggtaactagggaactcccgtttcctagactgcagtacagtgtcatgatctcggctcattgcaatctctgcctcccgggtttgagcaattctcatgtctcagtctcttgagtagctaggattacaaatgtatgccaccatgcctggttattttattattattattattattatttttgtatttttagtagagatggggttttgccatgttggccaggctggtctgaaactcctggcctcatgtgatctgcccgccttagcctccttacatgcgtgagccactgagcctggccaaaatattgtctaattattcatcattctgtagtgttgagtaaatgtaacttttttgtgtctatattatgtagttttgagtaaatgtaactttttttgtctgtgtctttggacacttgtagccaaaaagaggaagaagaacaggaggcatacagggtattttaaggtctagattgaacctggaccttggaactgcttcctaggtgttgcaaatgggtaagaaacatatgtaacaaacctgcacgttgtgcacatgtaccctaaaacttaaagtataatagtaaaaataataaaaaaaagatcaaaaaaaaaaaaaaaaaaaa

SEQ ID NO: 1845 - DNA, 789 bp, Homo sapiens
  misc_feature (15)..(15): n equals a,t,g, or c
  misc_feature (47)..(47): n equals a,t,g, or c
cgtatgttgtgtggnattgtgagcggataacaatttcacacaggaancagttatgaccatgattacgccaagtctaatacgactcactatagggaaagctggtacgcctgcaggtaccggtccggaattcccgggtcgacccacgcgtccgctcttatattaaaataatacctggccgggagcagtggctcacacctgtaatcctagcacctttggaggccagggtgggcagatcgcttgaggtcaggagtttgagagcagcctggccaacatggcgaaaccccgtctccgcaaataatacaaaaaatgagccgagcgtggtggcacacgcctgtattctcagcctcctgagtgcctgggaccacagtcatgccccaccacacctggctaatattttttgtttttgtagagatgaggtttcgctatgctgcgcgggctgcgtcgaactcctggcctcaagcaaacctcctacctcagcgtcccgaaggctgggattatgggtgcacgccactgcatctggcccttttgtaggtattttttccccctttctctgattgtacctattgatttttctccctttctctgattgtacctattgattgtttagagtctctgaaaaatcacactcttattggctaagtcttcaccccataaatctttcctaataaatgctcattcagactctcagaactttcagcattaaagagttttctattcatgccctcaattcctcccataagaactaaagtgatcttttgcaaagtaaaaaaaaaaaaaaagggcggccgc

SEQ ID NO: 1846 - DNA, 354 bp, Homo sapiens
ccacgcgtccgaattttttcattttgcctaattttagacttattgacaaagtgctgggaagacaggcgttagcaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaaaaaaaaaaaaaaaaa

SEQ ID NO: 1847 - DNA, 1487 bp, Homo sapiens
acccacgcgtccgaaaaaaaaaaacctcatggtgagataggtgaaaaatagtctaaaataataggaagccctttgctggtgctaaatttccatttgacagatggtgggcctgaggcctagaggcatcggggttgcccaaggtcacacaaagcctgacattgagcatttgttttttaatttcaaatctattttctcttacaccccatctgccttcatttctcttgctatgaaaagacactgatggtttggcatacagtctgggcgtagtcaacattttgtgggagaaaaggaaggaattagactaggagatctgggatgcaagtatatattcggcccttgattagccttttgctttggggttaaaagggagtggctgggggtgggtgaggttttaactagatttccaagaacctctttcctccttgcttttgaagttgggggtgggggtactatattggtttgtcagtcagctactcatgccaaacattaggtcattatcactttcactaaattcactcattcaacactttttggtctgcaaaattttgaaacgggaaagagttaatgaatacccaggcaattttaacacaatgatgaaaaaggctacaaaggagtaaatctccgtgttatgaaagtgtgcagaggagaggtcgaggaagggctctaggagggaattatatctcagctcagattggaccccaaaggaggagttagttgggtagaatggaagagagtaaggaagggaggctctctgggcagagccactcctgccctccagagagatagcatagcccttgaaggaggaacttgaagacatcttgtttggctgaagcctcaggtaagtgggggatgtgacaagaggtgaagttgggtcattagagggcagaagagcttctaaccttattcaagagtctggactttakcctagagcagtagggagccactgtaggatcatrtatggggaggccawttaggacgttaagaaacaacatcatttgcccattcccttcacttggacctttgccgtttacaaagtactttcacttatgttattactttatgtaaactactcaataatcatataaggtagaaggagatagatatctccttgttgtagacaaggaatctaaagttctgagagggtagttgactgattaatcaagtaagaagctagaggggccaacacgtgagcctcgcacttcagttctggactgtactctagctgcaacaacctcttcctctcaaaacaggtgctggagttttccacaggactctgtgtgttgggcacttacccataggaccagcccctttcagtggtctacaataactattggccgggcgcggtggctcacacctgtaatcccagcactttgggaggccgaggcgggcggatccacgaggtcaggagatcgagaccatcctggctaacacggtgaaaccccgtctctactaaaaaaaaaaaaaaaaaaaaaaaaaagggcggccgc

SEQ ID NO: 1848 - DNA, 820 bp, Homo sapiens
  misc_feature (779)..(779): n equals a,t,g, or c
  misc_feature (798)..(798): n equals a,t,g, or c
acccacgcgtccgcccacgcgtccgctaatctatgtcatttaagttctagattttacagtattttggagtgatgaataaatagcatgctgttcttctatagctagcaaacaagactcagctttggagacaagaagaaggaatacaggagatgtttccttgaatgagtcttcttcctaaactctgctagaagtatgtcagaaagcgaaggttacctcagtctccaagtcatgaaaacatgaggtctttctgttttctagggaaagtatttcatttcctagtgtggctttttgcacaccccagaaggaggaagacaagccttcgtgtcacctttacatggtagttgagatgcttcacatttgtacataacatcttatatgatcgaaagaggaactcaaactcgacaggggagaataaggaaatacatctaaaactgacaattatgttaatccctcaattccctgggcccccaaaatagtctcctctatttgccatttcaaaatagctaatgagagggtaattggacatgtagacactgaatttccactgctcatggtttccttccctgggctcccagtcacccggaaggccccggattacctcaaatgtcataatgggktcatcgcattacgaattacctccttctgccaataaactacaagttctttgaggaccaaaaaaaagwmraaaaaaaaaaaaagggcgggccgccctaggaggatccaagcttaaggtacccggtgccattgggacggccaatagctccttccaaaagggggcnccctaaaattcaaattcanctgggccgttcggttttacaaa

SEQ ID NO: 1849 - DNA, 751 bp, Homo sapiens
gcacaacttcaacagattttctgtcatattctcaccagcacatctgaatgaggctttgtgttttccttgctctcttgcatgttccttttcaactcatggcccacagtgactctcagagatttatgccaaaattgcatacaattgttttctgaatcataacttgtctatttttctgcctatgtgtgctactttcagtttgtttctcatcaacattttgactctcagaagagcctccatttgcccctttctctctttaggtatctaagatctttgaacacctggacctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttawgtttcagactattgttagaaaaacaaaacaagaaaaaaaaaaaagggcggccgctctagaggtccaagcttacgtacgcgtgca

SEQ ID NO: 1850 - DNA, 1084 bp, Homo sapiens
  misc_feature (864)..(864): n equals a,t,g, or c
ccacgcgtccggatgtatcaaattacaaggtttcatttgtaaataaggtgattaaaatgacaaagtgtattaaaagaaattgtattgtccagtgaagttttaagaaacagaaaccataaggtgattattatttttcaagccccaaaggagaattcattagatgacatacttttaaagttcattacaggtgtgagccactgcacctggccgtataattttctttttatcagggatgtaggctcaaatgagattgggtgccaaaacttcattatttttcttttcttttcttttcttgctagtttttgctaaacttcttttgttaaagaaaggcagttactgttactgagatagctcgatggtatcctgtgcatttttttttgaaagctcaaatagaagtctcacagttttagggagggattttttttagtctacaaaaagttattagtatgcctgtcctcttagtactgtactgcctagttactctcctttcaaaaaaaaaagcgtatatttattatatttccatggtaaactagcagctacaataatgtacgcttttttttttagtctacaaaaagttattagtatgcctgtcctcttagtactgttcctaaaaatgcttgtacattctaaaactgcaattttactgatagttgggaaatgaaagtgcaaaagaaattaatgacttgtgaagttctggtatttcattatgtcaagacaagattttttttttttttcctgagctgtagatctcatttgctgttggttgattaagaaaaaaatcttggccaggtgcgataggctaagtctgtggtcccagcactttgggaggctgaggtgagtggattgcttgagctcaggagttcnagaccagtctgggcaacgaggcgaaaccccatctacaaaaaaaaaaaaaaaaatagaaaaattagccaggcctgtacacccatagtccctcctactcaggaggctgaggtgggcggattgcttgagcctagaaggttgaggctgcagtgagccgagatctcaccactgcagtctaccctgggtgacagaatgagaccctgtttcaaaaaaaaaaaaaaaa

SEQ ID NO: 1851 - DNA, 1403 bp, Homo sapiens
ccacgcgtccgcccacgcgtccgcccacgcgtccgatgacccatggtggtcatgaccaactgcttttaaaaataccgaaccaaaactgttttaaccttgccccttgaattatagcagtttatgagtcagcagcttatgctataagggatttgattattatttacttcgagaaaactggcttccttgaaatctcctgatatgcatgtaaaactgtcatgtcatgtaaatcaaaggtaatattcaaggtgtccaactaagtgtaaggtccaaaataatgaccaaatgatataaagcaacttagccttggaaacaatatgaagcatagtactaatgtagaatagttgtattggagttgactttatataaaaatgtcttacatcactctacttaaattcatcttgtatttcttctctctagtatctgagttcagaaaacttattccatttataatgttctctttatattggttatgctattttgatcttaccattctttttaaaagtcttattacatatttatttttccttttttctttctattctatcattatacccataagagagtttgttacacctgaaaagtgaaacaaactaaattaaaataaaataaaagaataaataaagaacattggtcaagtctacaaaagttaaaaatttaaaaatcacatggctttgcttatattgaaataaatgttttgtgtatggttaatacaaacttctctatttcctggcatttattcaatgagtaatgaatagcgtaatgttactttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgttaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcgggaaaaaaaaaaaaaaaaaa

SEQ ID NO: 1852 - DNA, 1566 bp, Homo sapiens
cccacgcgtccgtgctatgttgccccgctggtctcaaactcaatggactcaagcaatcctcccacctcagcatcccaaagtgttgggattgcaggcatgagccactatgcctggcctagtaaaatatttttatactaagtagagagagtagattcgtggaaaactcttaaactcaccaggtactgcaatgaaacttctagcattggtgattagcatactaatatgtactgggcaaatttataattgttagtaatttgcaatggagtcttttcattctgatattcaaagtattttacaaacactaaactttcaaaatctctcttataataggtattgttaaattaattccatatttcatatgaaaaaacaaaagctgagggaggcaaagttacttacctaagaccacacagtatttaactgatggaacctgagtagttccaaatttccgttactcaactctaacccgcatataaaataaaatcagtgtaatgctaagaaatactattgtacctccaagaataaacttgacaataaaaatattgtcatggcagtttaaagaaatgtctttattaaaatgaggattccaaggtaaaatcctctaagtataaacatatttatataagatatttatatttaagaagatagtaatttcattcaatattttgtttttaatatcatgatcattaagttacatagattctcttctggtaagcaaagtgcaaaaaaagccaaaattgttatagactgtgattcaaatactctttcatatagccagggtgataaactacttatttattgaacttgactgtttaaatataaaaatgattgtcctaatggagaaagcccctaaaaagcaagtagctccttttgcataaaagacttttacattattttggattttagtgaacagtgtttttttctattgtaatttctgattagatatcacattatttatgaattgtttgttatggtaggagtatagtatcttttggaagaatttatcttagtatatattaaccaatgagtcaattaagattagccaatttcaatattatccttaagcagtattaccattgtaatgctagaatagacatatcccagaccattaaaaacctgacaattctttatccaaaaaaaacaagcaggcaaaatatttacaaaactattaaaagattggggagctaaagtagtggcaaatgcattactctgaaaatcctcacacatcctctgaaaaccaataaagatgaacaaataagactacacataaccaggctgggcacagtgactcacacctgtaatcccagcactttgggaggctgaggcaagtgaatcacctgaagtcaggagttcaagaccagcatgaccaatatggtgaaatcctgtccctacaaaaatacaacaattagctgagtgtggtggcacgtgcctgtagtcgcagctacttgggaggctgaggcagaagaatcacttgaacccaggaggcagaagttgcagtgagccaagatcatgccactgcactccagcctgggcaacagagtgaaactccatctcaaaaaaaaaaaaaaa

SEQ ID NO: 1853 - DNA, 668 bp, Homo sapiens
ggtaaactatcttgagattaaatggaggctgcaaaatcactgtgtcccagggctcctttgtcttgctctgctcttcttctatgcagtttctgtattgtgggcgaggatggttaccattgtgtctgctaataagaagaaaaagagaagggcattctctttacctttaagaggagtttgtgtatatcactttcactcagatccctctggctctaactttgtcacgtcacaaccagttgcaaaggaggctgggaagtgagtgactctgacctaggcagccatatgttgcacttaatttttattactgcataagaaggagagaacagattctggggagatagccagctatctgtcacattaaggtttgagtcagatttatttycattaaaaaaaaaaaaatggcctcaggcctgtaatcccagcaggytgaggcaggagaatggcgggaacctgggaggcatagcttgcagtgagccgagatggcaccactgcactccagcctgggtgagagcgagactctctctcaaaaaaaaaaaaaaaaaaaaaaaagccgttgattatttaaacagttaacttttttgttgttgttctggaatgagtcttggttactgtatagtatgtattaaaaataaccattagcaatctaggcatagtggtatgtgcacagtccc

SEQ ID NO: 1854 - DNA, 313 bp, Homo sapiens
gctgacaataccaaatgctgggaaagatacagagcaacaggaactctcatgtcagagttcctgttgctctgtatctttcccagcatttggtattgtcagtttaaacacaaatgctgggaaagatacagagcaacaggaactctgacatgagagtaggaatgcaaaatgagacagccactgtggaagacagtttggcagtttcttagaaagttaaacacatttactctatggcccaggatctcattcctggggatttactcaagagcaatgaaaaccccactcaaagatctctacaatccaaaaaaaaaaaaaa

SEQ ID NO: 1855 - DNA, 1082 bp, Homo sapiens
  misc_feature (1065)..(1065): n equals a,t,g, or c
gcagtcactttagtaaaataagtacattatattacatgtcattataatattgtgttatcacataaactgagcataccacaatccatattctacggactgtcttctcctttttccactgattacatgtgagtggttcttagataacacaccctaaagacaaagaaagaaaggaagagaaacagaattaacaagagagggaaaagagtgtcagtttcctttgctatgactattaaatgactcagtgaattttcttagggtaaagttactgccattcaaaattatagtaaattggtaatattttacagtcatatatttttkgtttcagctgagtatatttkgttycagcttaagtatgggcacatatctcccacacttttttagatcagatatgacacataaaaaagatggctttggttttttaaaaactcttacaattagcaactaatggcagtgtgaacatataattggttttataggtaaatcaatttgtcgacttacaaacttttaagacttcatttgttattcataactacattttgctgaggaaaaaaatacttgtttatgtcaaaaaggggagaatttccattaagttcatactctccatgatgagaaagcacaccccgaaataagacattaaatgttagaatgtattacttttcctggttagaaaagaacttggctttgggagtggaccctatgcgtatcatggtgtggcaatgccattttgtttccaaagataacatttgtagatgtacagatgtcctgaactttattaaaccacagctgtggttatcacatatttattcaaaagatattacagctatcaaagcagtatgtcagcaaagtccttagtagtttgcttaaattgccctttcattttactgtatctgtaagtattcaaccaatgtctttaaaagcctgagtaaaaaaaaaaaaaaaaaaagaaaacacaaataagcaaacacgaagcattatttacatggaagcattcagaaatcatgaatagcattatcacaaatgagttatgacattttataggttcacaaaaacgagagaaaaaaaaanaaaaagggcggcccgct

SEQ ID NO: 1856 - DNA, 1316 bp, Homo sapiens
  misc_feature (24)..(24): n equals a,t,g, or c
  misc_feature (37)..(37): n equals a,t,g, or c
  misc_feature (48)..(48): n equals a,t,g, or c
  misc_feature (61)..(61): n equals a,t,g, or c
  misc_feature (121)..(121): n equals a,t,g, or c
  misc_feature (1305)..(1305): n equals a,t,g, or c
  misc_feature (1308)..(1308): n equals a,t,g, or c
ccatttttccccccaggaaaccancctatgcccatgntttccgccaancttttaattccgnctcccctatagggaaaacctggtacgcctccaggtcccggtccggaaattcccggggtcnaccccacggcgtcccgcaaaacatcagtgcctttcaaatgctaaggaaactctgtcaaatgatctttctttttttgttttttgttttttgttttttggtctcacaatatgtctcaccattttatagtaacaccttctttggtgtccagtaaaatgaaaacttgagagatttctactgcttcaacaatttttttaattacgtggagattttaattttctatgagctatctgaaagaagagtagaaaataaatacaatcttgaaaaatcccatgaaaaccataggcaaatattaaatgattgaggcttttcttttttaaaacgtggctatgttctttttagatagcctggattcagggacttgggaccttgtaaagccaaagctgattgacactcataaggatgtcttcctgtatgccattctaatagacacacatgttacctgatagagctgggcagaggtgcttcagtctcaggctgaaggttctgaagtccagggaagttgggtgctgcccagggttacaagccatgagtgggagagctcaagtataagacacttaggccagacttcgtttcacaagtccaggctgctcctcaccaaaattctgtgtgtatatatatattttttctttttctgattctcatgcatattgtagataatttggaatatacagtaaactgaaaattctatatccacatttctgtgagctttttaaaatgtgagtgattactggccaggcatgggggctcacatctataatctcagcaattcgggaggctgaggtgggaggataacttgaggcctggagtttaagacgagcctgggcaacatagaaagaccctgtctctacagggagaaaaaaaaaaacctaacaaacattagccaggagtttgagcccaagagtttgaagttacagtgggccttgatcgcaccactgcactgcagcctgggcgacagagcaagatcctgtcttaaaaaaaaaaaaaaaaaaaaaaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcacacatccccctttcgccagctggcgtaatagcnaanaaggcccg

SEQ ID NO: 1857 - DNA, 722 bp, Homo sapiens
  misc_feature (665)..(665): n equals a,t,g, or c
  misc_feature (719)..(719): n equals a,t,g, or c
ggaacaaacaaaaaaatctctctaacgttttattctgccttatcctcaattggagaaagggatgaaggctgccacgtattagctgtgatttcttaacttctctacctttaatttcctcatctatgagatgatgttgaacctgtctacatcataagtagttaaggatgaaatgaatgggtatatgaacattgtgttggggacgtagtagatactcagcaaatgtgtcttcccagtgatgtcacatttcctctacttctgcttggtatgtgtctcgttcccctgagcccagctcatgtcactgtgacgtgagagggcaggtgaagtgttagttgttcccactccatcatgccctttcacagttgttagtctgatgctaaagacttaagatttatttcttcattgttgttgttgttgtttttgtagagatcaggggttcgagaccagcctggccaacatggtgaaaccctgtctctactaaaactacaaaaattggccaggcgtggtggtaggcgcctgtgatcctagctacttgggaggctgaggcaggagaatggcttgaacctgagaggtggaggttgcagtgagctgagatgacgccactgtgctccagcctgggcgacagagcgagaccctgtctcaaagaaaaaaaaaaaaaaaagggcggncgcyctagaggatccaagcttacgtacgctgcatgcgamgtcawagccctccanaag

SEQ ID NO: 1858 - DNA, 858 bp, Homo sapiens
ccacgcgtccgaaaaaagggttatgtaaggaaagacaagagtatgtttaagacggtttctaccattttgcttagggcagtccctataatcttagaggcaacagtaagagagtgaaatattgcaggcagtgaattgggctaatttgccatcactccgatttcttcaaaactctcttaaagatgagttaatgttgctggcctaaaatagtctcatatatgggactcccttagaaatgatagtgatagtgttttatttaataaatctgctgtgatggtctaaggcaaacttgacttatggaattccagttagcactgttgatgataataattacagttggttttgcatctgtacagcactttacaattataaatactctttatggaagtagtttccttgggatgatatatatctggccattattctgttcaataggtgtgctatattatggcaaatgttgcaattatcattgtacatattggtatgtttatttgtatatagaatcatactcataccacagagtctaaagaagtagcagcagtgtggtgtagttagcaatcaagaacactggaccttaaataactgggtccaaatatcactttcaccatttattcactgtgagtcatgagaaaattgttttagttttgctgtctgtacaatggcatactactacctgtctcatacacacacacaggcacacacaaagttttactaattggttcatactaggaactctccaagtatcaattatccctgttacagaaacagtatgtatagagagacaatcatggagattccctgtccaaggattttcctgatagcttcctctggtccatatcaaaatgaaaaaaaaaaaaaaaa

SEQ ID NO: 1859 - DNA, 1206 bp, Homo sapiens
  misc_feature (38)..(38): n equals a,t,g, or c
gaaaccccatctctttaaaaaaaaaaaaaatccaaaanttagctgggcatggtggcatgcagtggtagtcccagctactcaggaggctgaggtgggaggatcactggaacccgggagcagagactgcagtgagctgagatcacactactgcattccagcctgagcaacagagcaagacacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtagtatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcatcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaawaaaaaaaaaaaaaaaaaa

SEQ ID NO: 1860 - DNA, 2102 bp, Homo sapiens
ccacgcgtccgcagccttggaaaggaaagcagctgagatccagaggagtggaaggctcccccttgactaaagctaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacgtgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggcatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttgtgactgaattccctttgacattaaagactatttgaattcaaaaaaaaaaaaaaaaa

SEQ ID NO: 1861 - DNA, 1289 bp, Homo sapiens
  misc_feature (1254)..(1254): n equals a,t,g, or c
  misc_feature (1285)..(1285): n equals a,t,g, or c
ggaattcccgggtcgacccacgcgtccggggagctcagccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcacagcagggccctgcggcctgccagcatggatctcctgcgcccacactggctggaggtgtccagggacatcaccggaccgcaggcagcccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaaaaaaaaaaaaaaaaaaaaaaagggcggccctctagaggatccangcttacgtacgcgtgcatgcgacgtcatagntctt

SEQ ID NO: 1862 - DNA, 868 bp, Homo sapiens
gggtttatcaaaaaatgtcatgaatgtttctatatttcttgttggtttatttctcattattgagttatatattgctggaagtttaacaacttctcttgaattccaacaggaagcatttgctaggtaggcatttggtacctaatggataatctttcatgatggataaatctgccacatcagtctctcttgactttgaaaattaaaatctgggcactttgggaatttctgctgtcttaattggctggcctgtcctgtgaacagccgtcttctctaaatggtataataactgcatttcagcgctgtctcattgtgagtctttttgaaagcttttaaaatgatgttgtgtgatccaaatttaaattaatagttaagcagtgtgttctaccaccaatgcaaataactcaactgaatgacaattggatcctgcttcactcagtttgcgcataaatggttgaggaaaactacatcataggtgacccccgttggtggtagccaaatttcatagtctactgtgtgaaccatcatgatttcagaagcactaaaatatagaaacatacattcttggccaggcacagtggcccatgcctgtaattccaacactttgggaggccgaggtgggcagatcacttgaggccaagagtttgagactagcctgtccaacatggtgaaaccccatctctactaaaaatacmaaaattacccaggtttgggggtgcatgcctgtaatccgagctacttaggaggctgaggcatgagaattgcttgaacgccggaggcagaggttacagtgagccgagatcgcaccactgcactccagcctgggtgacagagccaccctgtctcaaaaaaaaaaaaaaagggcggccgc

SEQ ID NO: 1863 - DNA, 2929 bp, Homo sapiens
ggaaagctgttacgcctgcaggtaccggtccggaattcccgggtcgacccacgcgyccgcccrcgcgkccggtcgcgaagcgcgcctgcgacccggcgtccgggcgcgctggagaggacgcgaggagccatgaggcgccagctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcatctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggraagggtagcacgtgcagctctcaccgcagatggggcctagaatcaggcttgcttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 1864 - DNA, 1141 bp, Homo sapiens
cttcagggcaacaggctgggatccaggcaaggtgcctgcactcagaggggcttcagtgctgagggcggcctgctgtccgtccctgcggcagactgggccctgtcccaccttcccgtcactcctcgatgtcacatcagagtgctctctcctgggtgggaacccgcgcacggaggaaacactttaccagagtaaacgagattataacttgtttgccagagaacctctcctgtggccatgcctgaacctctcctgggactgtccgtggtcttcacattggtgcttggacacccgtccttcgggaggggaggaaaagcggccggtaaaatggagacagtcggtggcgtgtgtttgccgattggactggcattggtatagacagataccaatcactgcacagacatttccaggggcccttccccagccatgtttagtggcactgacctcaggcagctgggcccccgggacagcaaccaggggactgccctggccctggatggcagccgggaccggctcacaagcttctgtttggagcagttctgttggcagccccccgcctccagtggagatgtgacacgactctttcttgcctgccaaacgttctctgattctttggatcatcgatcctaacacagcaaaggcggtattgttgctgtcctttcaaggttaatccaggatcagaaaagtctaatcatttctctgtggtttttggaatttccaaagagcacccagattttaaccctcagtcctcggggttgtccggctgcggctgtgctgctgttgagcattaagctcattccacttcacatgtaaacttgtttctatgcattcacctcctgggagactccacattcctgagagaactgcatggttatgaactcttactcgtgtgcactaaagtgcacgtgctgtgtgtgtactgaccctctgccctgtgggagccacgtgctgtggggagaacagaccagcagcagatgggactcctcctccaggaacctgctaccagctaggcgtggtggtgcaagcctatacttctggcactttgggaggctgtggcaggaggatcacttgaggccaggaatttgaggccagcctgggcaacatagtgagaccacgtctctttttgaaaaaaaaaaaaaaaaaa

SEQ ID NO: 1865 - DNA, 1285 bp, Homo sapiens
aattaaccctcactaaagggaacaaaagctggagctccaccgcggtggcggccgctctagaactagtggatcccccgggctgcaggttttaatgtttcgaagatggttgtaaagaggaaaattttagtatctcaaatgctttaaagtgagtggaattttgactgtacagttccttctagcagaaatcagtaaaccttgtaagatgcttcaacaaaaaatggggttgattccttggcacttcacagacatcctcacctttctgttccctcagaatcgggttcctgtgaggctgggtagtgggaggcagggatggaggtagcaggatggcgtgggtgggattagcaagtctcggagtctgttgtcccatctcaagggttccataaaaatcacctttttggtcctatattgggaacttgtgtggttctcagcttctgaccagaagctcctaggaagaactggctggtcacgactccttaagcttcatccttgatactggttgtgtcatctcagacccacgggttagtatggtagcttcactgggcttttggggctgggtctgactttgcatctgattgctctgggcctgtcattagcatccctgtaaggagagggaacggagtcagttcagggatattcttgccagaaaatctggggtcgaaatctccttccacttttcctcccagcagattggactcattggcgctctcatgttgaatttcaaactttaagatgagttggtcactggaaaggagtttgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacaaaaaaaaaaaaaaaaaaa

SEQ ID NO: 1866 - DNA, 1796 bp, Homo sapiens
ggcacgagaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaatgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgaagatagagttactttctggtacccagtatattggagtctgtcagaaactctataataggccaccagtttttattatttaacatttttatttgaatttctagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagctttaaaaaaaaaaaaaaaaaaaaaaaaa

SEQ ID NO: 1867 - DNA, 770 bp, Homo sapiens
  misc_feature (745)..(745): n equals a,t,g, or c
  misc_feature (761)..(761): n equals a,t,g, or c
  misc_feature (770)..(770): n equals a,t,g, or c
ggcacgaggcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcccccctgtcttgctttgtgcagaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataaraaaaaaaaaaaaaaaaaacncgggggggggcccggnacccaattn

SEQ ID NO: 1868 - DNA, 1444 bp, Homo sapiens
gaattcggcacgaggaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaaaaaaaaaa

SEQ ID NO: 1869 - DNA, 1892 bp, Homo sapiens
attcggcacgaggaaacctgctgctttcacagaggaaggcatttgctggctttcccaaggcaagaacaatgaaaacaaagtcatgaggagttctctctacctcaaatgaaggccgcagctcctgctcaagctattttggcagtctgagagaacagtacattctgaaccacattgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtatgctcccgctgaataaggaggaaaggaggaaaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaaaaaaaaaa

SEQ ID NO: 1870 - DNA, 2509 bp, Homo sapiens
  misc_feature (617)..(617): n equals a,t,g, or c
ggcacgagcattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattctcctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattcncatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctagggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaacttgctgtgaatttttttgtcatgacttgaaagcaaggatagagaaacactttagagatatgtggggttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactaatgatctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcaaaaaaaaaaaaaaaaaaaa

SEQ ID NO: 1871 - DNA, 2101 bp, Homo sapiens
  misc_feature (247)..(247): n equals a,t,g, or c
  misc_feature (2007)..(2007): n equals a,t,g, or c
  misc_feature (2024)..(2024): n equals a,t,g, or c
tcgacccacgcgtccgcccacgcgtccgggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggancgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagtkcakagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgatargtaaatatgtaaaattgtaaatatgtaaaanaaagaatggtgtctgcngtgcatggcattttatatgttaattttttagtttaaaatgaagtatattgaatgttttgcctttagcacccattttt

SEQ ID NO: 1872 - DNA, 1322 bp, Homo sapiens
cgggcaaaggcgccctggaccctggcgaaggacgcttgccgccgagcggactgattcgcagagtctgtacatagtgtatattgctctacccggycgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttstcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagttyaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaaaaaaaaaaaaaaaaaaaaaaaaaaaaaaactcgag

SEQ ID NO: 1873 - DNA, 1111 bp, Homo sapiens
  misc_feature (115)..(115): n equals a,t,g, or c
  misc_feature (1095)..(1095): n equals a,t,g, or c
agcggcagtcgggtgggaagccgtgtctcgcagtcgtggactcgtgcagctggggcgtcygcakscgctcgtmacccgcgtratgctgtttctggcgttgggcagcccgtgggcngtcgaactgmctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaarccagtgaagagaaacggcataaagatgasaaatgagcctatttgttagtgttcgtgctyaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttctntgaagatcggactggt

SEQ ID NO: 1874 - DNA, 1514 bp, Homo sapiens
gctgcaggaattcggcacgaggcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggctaaaaaaaaaaaaaaaaaactcgaggtcgacggtatcgataagcttgatatcgaattcggcacgaggtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttaaaaaaaaaaaaaaaaaaaaaaaaaaaaaaaaaaaaaaaaaaaaaa

SEQ ID NO: 1875 - DNA, 2799 bp, Homo sapiens
  misc_feature (2794)..(2794): n equals a,t,g, or c
  misc_feature (2799)..(2799): n equals a,t,g, or c
gcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatgggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcarcatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggtttgttttgttttattttttaatgaaataaacctatattcctgaaaaaaaaaaaaaaaaaaaaaaaaaaaaaaaaaaaaaaaaaaanggggn

SEQ ID NO: 1876 - DNA, 990 bp, Homo sapiens
accatgtttcatcatcctgtagctacatctggtcttccttgtgtgctgggggactgcagataggtcaggggtatcagcctcagccactcagacaaggaaagggggcaccacatgagctcagggacccccacccccatccctggcctgggtgatggtacagcgtctggccctgccaggtccttggcctgcacaaagtcagtgacagcaggtgaaatgcccagctgggtgcctgcctggagcgggtgtggggcagtgagcccctgtgggtgtgggcttgggagtggctgtgacaggtggtgagcagggcaggggcaatcagacagccctcagaaggcctcatggcccccggtgagctgcaggaagaggtcttcatccagctcctccccacgggcccgctcccgcgtcgacaggaaaatgtagcccccgatatactcgtgtacaattcggcagctggcagacacgcagctgaaggccacattgatgtgttcatcaaactcgatggccactgccggatgtcccagttgacattccactggcgcatgttgctgaaacgccaggtcttgaccacgtcgcccacggccaagtcgatgcggatcagtcggttgttggcgatgcccaggatctcgtctttcctgctgcccttgaacctgaccatgacataggagatgccgaagtcgggcagggactgccaggcctggatgaagcgcagctgggcctctgccagcgacaactgggccacattctggtgggcttccaggatccgtggggtgagctgcttggccttgaactttcgctggaaacggggggcaacaaggccgtaggggttgaggccctcggcagaggcatcagggccgtgggggtggttgcccgggcccccactgcccgtgcgctgcaggctgaggaaggccaggatggcctgcacctcgctggtgtagctgctgtcggccatggtgcggcctttggaggccaggcggcagccagcctcgtgcc

SEQ ID NO: 1877 - DNA, 1316 bp, Homo sapiens
ggcacgaggctcccacttataagggagaacatatgatatttggttgtccattactgagttacttcacttagaataatggtctccagctccatccaggttgctgcaaatgccattatttcattccttttatggctgagtaatattccatggtagaatgttacttttgtttatctacttgttggttgatgggcatttaggttggttccatattttcgcaattgcaaattgtgctgctataaacatgcatgtgcaagtgtccttttcaaataatgacttctttttattaacaccctgtagttaataacctgaattctttatagcttgcattctgaaacatttttctcgaactatccgccttctggcctgttccagtcattctggctttcatcttgatttgtttttcttaaaactttctccagcttccctctgcatctgtgattcgtgctctgcttcttgtttgtggctttggatcaataatgctacagatccagtctaattaatcatggatcaaaagctaaagcatccttcccccagatggtttattattaataccacccagaaaaataatttataatttaattctctacctcatagagtttgggatccttggtagaatgtgttcccttccccttttcttcttcgctatttcctcctcttcctctccatcaaaagtggctttatctccacctttgcagctgacagcaaccctcccatgctccgttgatgaagccctcctttcttaacccctcgtccatatggctctccctccaccctgctccatctcctgtgatctcaaggcctcggagaaatgatctcaaggcctcggagaaatgaaaagtgacctttggtatttgagacaaccaatagcaaaatatagctcccacttccaacagcccatattggtgggggagggatttgcttcatacgtggtctgtgttgggccattctccttctccatgttttctctgttcttacagcaccatctttttgcctcatttctttgctctactctattcctcccccatcatcgtctggtgactcacactgtaatcctagcactttcggaggatcacctaaagtcaggagtttgaggccagcctggccaacatggcaaaaccccgtctctactaaaaatacaaaaattagctgggcgtggtaatgggcgcctgtaatcccagctactcaggaggttggggtgggagaatcacgtgaacctgggaccgggaggctgcagtgagccaagatggtgccactgcactccagcctgggcaacagagcgagactccgtctcaaaaaacaaaaaaaaaaaaaaaaaa

SEQ ID NO: 1878 - DNA, 1146 bp, Homo sapiens
ggcacgagatcattttgatttctaacaatattggtgttggttattggaccttccttccatgaagcccagtgagctgcttctgacagaggtaccaagagactacaggggaactaatgggattgtcctcagtgacatcagttttaccagctggggactttgtttgaatgccctggatttactcactgaccactctggaaatgcaatctattgattgataaccctccttgaacttatctgtaaaaccattcatgaaatattttatgtttccataggctggcaagttctcatttttgtgtgttagattttcatggtgaccctctggctctataattcttttatttgaaaaaacacaaccatgtttactctgtcattactcttcaagctttttcgtatttcattttcccttccttttagaaggagtgttttcacactgtagcttttctcatttctttatgcaatcaccctgagagatcgaaagttattaagcataataacctatattgtgtcaaattgtgggtacatccaaagtgcagccatgcgtgggtgttaataggaaattccaaagggttcataaaaatatcttcagaagtttaatacattcagaatatatccaattagcattagtggatttctaatttcacttgacacattcatcataatgaattttgcttttgaagtagtgttctgtttaaactggcgctctggtctatggtagtgtttttttttttttttttaaaaacaggcttactttcaacatccatttacaaacatttgttgaaaaatattttaggagtatttgtttaaacattattccgaatttactgctccataaagcctagtgaatatttaaattcttgaatatgttgccagaaaaagaagcagagatccaaaaacaagtatatgaccagagttagagctgaaataatagcttgttgaagaagagaaaattgtaataaattgctttatcaaacttgctttcaaaacctgttttttaagttgggcacagtggctcacgcctgtaatcccagcactttgagaggccaaggtgggtagatcacgtgagctcaggagttcaagaccagcttgggcaacatagcaagacttcatctcaaaaataaaatagcgttaaaaaaaaaaaaaaaaaaa

SEQ ID NO: 1879 - DNA, 545 bp, Homo sapiens
  misc_feature (46)..(46): n equals a,t,g, or c
  misc_feature (536)..(536): n equals a,t,g, or c
  misc_feature (544)..(544): n equals a,t,g, or c
ccgctctagaactagtggatcccccgggctgcaggaattcggcacnaggtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagagaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttcaaaaaaaaaaaaaaaaaactcgagggggggcccggtacccaattcgncctatagna

SEQ ID NO: 1880 - DNA, 606 bp, Homo sapiens
ggcacgagctcgtgccgactcgtgccatttaacctgatacagtcatacctattaatgaattgcatgctcaaaaattacttataattaggagtataagatcaaagatgtttggaaactaatgatatatattgatttaattagccatgtccctattgataaacttttgggttgttttcagtgtttttctcttataaataatactgcagtgagtaaaaccttgatgcctttttctgagttctcttctcagccactacaaatggaactgctgttccataaagtgtaaacatttatgaattgaatggaaaattccaaattgctttccaaagtgtctgtacagggctgggcaccatggctcatgcttataatctcagcactttgggaggccgaggtgggaggatcgcttgagcccaggagtttgaggctgcagtgagctaagatttttgctactgcactccagcctgggtatatcagtctgttttcatgctgctgataaagacatacctgagactgggaagaaaaagaggtttaattggacttacagttccagagtctcaggcaggcctccttgtcccagatcccttgtgaatgcactaactctgaccggca

SEQ ID NO: 1881 - DNA, 1035 bp, Homo sapiens
ggcacgagtttctgacaaggcacagctctggctgaagcttcatttaccctcaaaacctctgctggtcaggatgaccaggtaaataattttctgaagaagacagcaaagcaaaagtgtgctagatacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtgctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaa

SEQ ID NO: 1882 - DNA, 2414 bp, Homo sapiens
ctaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtytgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaaccttkgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgktatataccactgagataaagtgttagcmaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattgggaaactaactttgcatatgctgktagctattattyygcatcatgggcttcatgggaagaacatgktgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaagaaactaaaaaaaaaaaaaaaaaaaaaaaaaaaactcgtag

SEQ ID NO: 1883 - DNA, 582 bp, Homo sapiens
ggcacgagatccacttcccataggctcatcacctggcaatccccaattctctgtcacggtagttctgcctttttaaaatatcatatacataaatttacattatctggtcttttgtacctggcttatttcacatagaataaatgttttgaagtttatgttgtgtgtatcaatggtttgtttcattttgttgttgagtattctactgtatgaatataccaaaatttgtgtgtctgttcaccgattgattgacatttgggttattacaactttaaagctactataaataaacctgctaaaaatgtttacataagagcttttgcattggtatagattgtcatttctctggagtgaatatctaagaggagaatttctaggttatatgataagtataaccatattgttaagcattctagttgatgtgtagagaaagacaggatcgaaagcaattaaaatgaaagaatatttcaaaagataaaagagaatatagaataacatggttataaaagccagtggaagagtgattaagggatggaaactggagtttcaatgttagaacttcagaaattgaaaaaaaaaaaaaaa

SEQ ID NO: 1884 - DNA, 1426 bp, Homo sapiens
  misc_feature (506)..(506): n equals a,t,g, or c
ggcacgagtactcatacaaattcttagtatatggtgcgtatactgtcaatggtagttatcatcatcatcattattaatgggagcccattatgtgtgctgtcttatttcatcttcacaatattcacatgaaataagcattatctgtactttatgaataagaaaactgaggctcaaagacataaatgtcttaatcaagtcacccatctattatcagaaagaacggggatttgaaaatgcatcttcctagagacaaaacttgtttccattatgccacaggattttactatgtaccacggctttaaaaataataactcttaggaggacttatttataaaagactcctggtattgcaggaggaaagtaaatatattttcatgactctgcatctaactctgggttctttccttaatcccatgtgtgtgtgtgtgtgtgtgtgtgtgtcttttttaaagggaaaaatacccatagattttctcttgcttcagtgcaacattgcagatgatccntagtgatgacctttcccaaagttacattgtagaattcattggctaatatcggctgataccaccgcatgaggtgcataattaagtgatgtggtggcaagaccagattcattatcgtagacggtcatgtgccctgccatgacattttggtcagggacagactgcatatacagtggtgtgcccataagattataatggagctcagctaaaaattcctattcttggtgacatcatagccgtcataacaccgtagtgcaacacattactttttctatgtttaggtaagtttctatacacaaatacttaccactgttttgccgttgcctaacatattcagtacagtagcatactgtacaggtttgcaacaggctataccacaccgcctaggtatgtagtaggctgtacatctaggttcgtgtaagtaaattgtatgatgtttacacaatgagaaaatgttccatttcccagttcatatcctccttcttaagcaatgcatgagtatctcttctgttcttatgctttcctcttccaggaaatagatataagttgtgtcctagcaacaattttttgcttcacataatatctaaagatatctaaataaattaagattcactaatgactctagtggcttttaatgccatgagatattcctactagttctttctgtcattggtttattttcattatgtagattagaaatgaataaaaattacttccttattttacactaatactaataaatgcctctgatttttagagaactgtaatagatatatgatgtgttactctctttgactatttgtataattttgttttttaaagatacatctagattaaaaactactgttgtaagctgttgaaatcttccatatggccaaaattctgtcactgcctatagaaattccaaaaaaaaaaaaaaaaaa

SEQ ID NO: 1885 - DNA, 712 bp, Homo sapiens
gctggaaccaacaagaaaaccttaatatggaactgcaatgatgggaatttggggcattgaaagaagttgggttggcaacattgcttgggtgatttccttgctaacattgtactgtaaggtgtgagggcctttgcattagactctgactgggctctgtaaacctgagcctcattcttagaacctcttgagccccttgatgttgcccagtcaagtccatagtgactgtaggggctgaacttcaagggccacttttgcttatagccatcacctgagagcacctccagaatcaaaatggccttgggaagtacttgccccagagagagttttaaaaattattctgtcaatctgactcaattccttgtagatagttcatttccaggcatgtattttcttggagtttgttaaaaacaatggaaaaatcttatcttaaaagtacctcttgggccgggtgcggtggctcacgtctataatcccagcactttggaaggctgaggtgggcaaatcacctgaggtcaggagtgtaagaccagtctgaccaacgtggtgaaaccctgtctctacaaaaatacaaaaattaaccaggcatgatggcaggtgcctgtaatcccagctacttgggaggctgagatgggagaattgtttgaacctgctgcattccagcctgggcaacagagtgggactcaaaaaaaaaaaaaaaaaaaaaaaactcgag

SEQ ID NO: 1886 - DNA, 1702 bp, Homo sapiens
ggcacgagatcacacatcatgcggtcattctctttgtccttgtgccagtcgcacagaggctccggggagaccttggggacttctttgtcggctgcatcttcacggcagaactgagcactccgtttgtgtcgctgggcagggttctgattcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaagtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagctactgcagtcagtcacagaggctgtcttttcacacacccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcaaaaaaaaaaaaaaaaaaaa

SEQ ID NO: 1887 - DNA, 1720 bp, Homo sapiens
ggcagaggcccgtttcatcctttcctgccttcttaagatcttgcactgccaaattcctcactccttcaccttcaggctcttttgtcctctccctaaaaacagaaactaaaacacccttctgaccttttaatgttactgtcctctttctgttctttctgtcaccatcagacttctcagcttaccatctccatttttcacctttaacccattctgaactcattgaatcatgcttctgccaccaccatactactgaaacaggtcatcggtgacccacccccggatgagaccacttcatcaagtggtctcatcttcattcctcttcccacttcacttcagtaacattttatatattcacctctcaccttgccacattctactcccttggttactgtacagcagtgctgttcagtgtcttcccttccattctcacctccttcgctcttcctgtcttctttttaaatattagtgttccctagggttctgacctcagtctttaccctttcttacgtttctccagggatagtgagcttgtagcccgaagactgcattctctacctacagaattattatgggcattgtttttatttatttatatattttaaatagatttaaatgccttaaacgggatgtatacgcctttctattaagggcccctcttttcttaaccagatagcgccacatagttgttacytggtgsscactgaagttacctgatttgtgactcttgccctattttcaacctaaatggtttgatcccttatgattatcacccttgcttaagtattaccatgacttatgttgtctctgtggatctgctgccaaagtgtaaaacattattcccatatctaattarctaactgctaaactttaaatttatactcctaattgtttatcagaaatgtgtatctaaattagcatgaccaaaactaaattcccccaaaagaactgctctttttcttctcaactgggaatattttccccataactctactcgacattctaaccaaaaactttttgttttcttcgcctttcctttctccgttctcctctctactcccaagcaatttccccttcagtcttctctgtcttagaaaatcatccactcactcacatgtttgctgaagccaaaattttagcagttatctttatcatttaggttccagtcaggagacagttatttgaacagagagaattttttagaaagaattgtgaactaggtaaaaagtagctaaatagataactgaaaaagtaaaaagaaaacgaagatatcatggagttaaaaactggaagaagcaacaaccacctgtagggctgggagaacaggaagaaaagattggaacaaataagacttagaaacttaatgaagagggcttgtggaactgagctccctggtgctggagtctcttggtagaggcagaggtggggtacgtctgtgataaagctggttctccaaaggctgagaaaagtgccaactgtatttagttgctcttaaggaaagaagtgctgctgcagggatgagaagccttgccaggggtgacagtcacaggaacacaagcaagcccacaggaagcagttagggaggaagcagccatggtgtcttccatccagggccagcaggcaaagctgatgcgtagtgtgcagagtccttggtgcagcatcccaaagcacagtatagaagggtggggttagagatgacaaaaaaaaaaaaaaaaaactcgta

SEQ ID NO: 1888 - DNA, 505 bp, Homo sapiens
ggcacgagcagctgtttctatggtaattttttgttcattgttatcacttatagcttactctattatggcttttttaaaaaaaaatctctgtatattttctcatccttacttgtttgcttacttttctaaccattagtctaaattgacatttaggtaaatttgcttttaagttgaatacttaagccaatgattcagtcattttgtcttttctggggtgggtagtgcctactagacatttaattgtgctgcattttaatatttcttaccattcattataaactttttttttttagacaggctctccctccgttgcccagactggagtgcagtggcaccattttggctcattgcatccttaacctcttgggctcaggcgatccccccaccttagcctcctgagtagctgggactactggtgcgtgccactgccatgccttgctaatttttgtaccttttttttttttttctgtagagatgggattttgccatgttgctcgggctggtc

SEQ ID NO: 1889 - DNA, 485 bp, Homo sapiens
ggcacgaggttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagacattaatttagtaattttatatttgggaaaataaaggtttttaattttatttaactggaatcactgccctgctgtaattaaacattctgtaccacatctgtattaaaaagacattgctgaccaaaaaaaaaaaaaaaaaa

SEQ ID NO: 1890 - DNA, 2007 bp, Homo sapiens
cggcacgagtgaactcctgacctcaagtgatgctcctgcctcagcctcacaaagtgtggggattacaggtgtgagccaccgcacctggccagaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattaggaaaaatatactacaagaactatttacatggcatttacattataagtaacctagagatgacttaaagtatatgagaagatgtgcataggttatatgcaaatatgccatatgagggactggaaaacccagggattttggtgtcctgggggctcctggaactaatcacctgtggatactgagggacaactgtaattaaattgatttttggatggatgcaactgatgttaaatttggcgggggggaaatgttaggattcacaataacgtgagtactgtgggttggagtagagaatatgcttttcagactcattttcctttggaaattaatagtaaggtctcaagtgccccctacagccttgctactcaaagtgggttccacaaagtgttgacagtatggtactaaatagaaagtggctgaatgagaaatgtaaattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcatgtttcttcaattgtgtctttgatttttattccattgttcccatacatatgcagaaattgatcataatcatgggtatttgtaggttattactgtttgcatggaatttaactgtttccatactggtttatagaatacttaaaactatgttatggctttctttgtgaaaagaaatatcaataatggttgcttgtagtttaacatgggtttaaagtattcaaactaaggcttacgcatgactcaaaacccataatcttaaaaagattgatgggtttgaccacctaaaagtttaaaacctgtgtataagaaaaggcatcataaataaagttaagagaaatagccagctggaaaaactgtttattatatatgggcagaggattcatctcattacatagagcactcatatatttggaagaacagaggataaaaagatatgagtggactgttaatggcaaaataatacaaatggccattaaatatttgaagagataattagcctcattaataatttaatcagattggtgaataatgtgcatcgctgtccaagctgtgagaacactcatgcagtgtacatgaaaatgtaaattggtacagctttctggagggcagactggtgatatggatcaaaatgaaaaacatgcattcccttgatacagcaattctacttccaggaaattaattttaaggaaatagtggggaaagtaaatatgcaactataaagatgtttagtatagcattgtttatctggaaaaacatcatacaacttaaatattcattccctgttattaagtaatgatgcatccatacagtgaaaacactacagccatttaaaaggatgaagtaaatctttatacattaaaagagaaaaaaagttgctgtaactagttaagtgtgtctcactgcacttgtaaggttaataataattatttggaacagctcatctagtagacattgaatgctgctaaagattctgcaggtcagagatctatgtgtaacaggttaaaagcgtagcaacaaagcagtgtacagaatatagagaaaaattaatttaaaacattctagatacgtctttttaaaaaaaaaaaaaaaaaa

SEQ ID NO: 1891 - DNA, 1499 bp, Homo sapiens
  misc_feature (867)..(867): n equals a,t,g, or c
ggcgacaagtgacttaaacactctgtgcccagttttccgcatctgcaaaatggggagataaatagcccctacctcctaggatcatcatgagaatgaggtgtgcgaacttggccggcatgggttccatagcaggcactcaggggtgtcggccacgaagattattctttctcttctctctttgccgtcttatttcatctctctccgttatttggttcccctgtccttagtcccctttctcccccaatggcatcccaagatgcacaatagtggcaagtgcccagcctgtttccacagcctgatccccaccactgcgttggccagtcacccaagaagcagctggaccccatcatctggctctagggatgacccagttccagcacccccgcaaacctccgtctgtccccctacctccctcagcagaggcccagcccaatgcaggcccgtggctggatgggagtagctcttcccaccacccctgggcagggctctgcggagcttgggagcctcacctggaatcggccctcatgcctcagtagagaaggagagcgaggagagaggtgatggggctccgcgggcacccccgatgcacagtctccttctgggcttctgatggccacaaggccagaagacctgcccagaagaattcagtataacccagttcagtgaaattggagagaacgagggcctgcgtcttccgggcagaaggcagggttcctgccctctggagcccttggcctggcgcgggctgattaggacctaaatctgcctgggtggctgggtggccgagtggcgattgggctggttctgtaccgggtgtgctccgtggggggcgtgatctggcaaagccttggaggtgggactgtggangcaccattgattgaactgtgtcccctgcaattcacatgttgaagcccaaacccccattgtggctgcatttggagtagggcagtaattatggttaaatgaggtcgtatgggcgggtgctgatccactaggattaggatccttataagaacctgccaccttctctctgccacgtgaggacatggggaggaggcggctgcctcccacccaggaggagcccttactggacactgggccctggctgcaccttgaccttggacttctagtccccagaactgtgagaagtagatttctgctgattacgctttcctgtctgcggcctgagctaagacagcagcgcttggggagaagcagaatttgaggagctcctcagtggcaggctgccctggccctgctgtcagcagaggggaatggccatccatgctggcccctcaccagccgggccttcagtgagctccccgggtaggtgaagctctcccagctctgtgtcccccgccaaagcaggcccacaagcgagcgcctatggggtggagtgagagtgaggaagaaacattacccgaggggtcactctcttcagaagacctcaatgactgtagactactgaattatttccttaaaaaaaaaaaaaaaaaaaa

SEQ ID NO: 1892 - DNA, 1626 bp, Homo sapiens
ggcacgagctgcagtctccctagcatctgttatttattgactttttaataacagccattctgaccgctgtgaaatggtatctcattatggttttgatttgcatttctctaattgttagtgatgtggaacattttttcatatgtttgttggctccttgtatgtcttcttttgagaagtgtctgttcatgtcttttgcccagttttaaatgggatttgttttttgcttgttcacttgttcacactttttttttttttatagattctggatgttagacctttgtcagatgcataatttgcgaacattttttctattttgtaggttgtctgtttactccactgaaagtttcttttgtagtgcagaagctctttaattaggtctcacttgtcaatttttatttttgttgcagttgcttttaagcacttagtcataaattctttcccagagccgatatctagaatggtgtttcctaggttttcttgtaaaattcttatagtttgaggtcttacacttaaatatttaatccatcttgagttaatttttgtatatggtgaaaggtaggggtcctttcaccatagaataaaacgttgtttcattcttttgcatatggctagccagctatctcagcaccatttactgaatagggaatcctttccccattgcctattttttgttgactttgtcaaagaacaggtggctgtaggtgtacagctttatttctgggttctcaattctgttcccttggtctgtttgtctgcttttgtaccagtaccatgctgtttgggttactgtagctttatagtatagtataaagtcaggtaatgtgatgcctcagctttgttctttttgcttgggattgctttggttatttgggttcttttttggttccatatgaatttcagaatagttttttctagttctgtgaaaaatgacactggtcatttgataggaataacattgaatctatagattgctttgagaagtatagccattttaacaatattgattcttgtaatccatgagcatggaatgtttttccatttgtctgtgtcatctgtgatttctttcagcagtgtttcctagttctctttgtaaagatccttcacctccttggttagatgtatttctaggtactttgtttttttgatggctatcgtaaacaggattgtgttcttcatttggctctctagcttggatgttattggtgtatagaaatgctactgatttttgtacattgattttgtatcctgaaactttaccaaagttgtatgtcagttccaggagccttttggtggagtccttagggtttcccatgtgcagaatctcatgattccttaaaagcatgcatttctacttaaaccatcatgtttacttttctagagagcaattaacttggaggtgggtgccggggaggttaggttgcttttgtaatattaatggatgtacaccaagaatattgcttctgagaatgatcttatcctcattgggaaagatttttctgtttttagttgaaattgagatgaaatacatcttattataaataaattttgactcttactaatgattacaggattgtagacaattaactgtcttcctcatgctgagtacataaaaaaaaaaaaaaaaaa

SEQ ID NO: 1893 - DNA, 2397 bp, Homo sapiens
  misc_feature (155)..(155): n equals a,t,g, or c
  misc_feature (1195)..(1195): n equals a,t,g, or c
ctttttttttttttttttaggttgaatcaaagcaagttgtcttcagagactgggatccgagatagaaaacacacagtgaagtttaatcaggaacccaacctccggtcctctgctacaaccacggaaacggctccaaacttgaggggggacccccnaacgcctgcttttggcccaaagctctgccttccagccctcctcatacccactggccacctaggaccaggaaaggggggtagagccctgagaattctgggtctggggtcaccagctcccacacctgtgctccccggccccacacacatgatgcccaggggtgggcaatccctgacagcggtggccggcacttgggagctcctgctcagccacctgccacggcccaccctgggggtccggcaggagccagggcagtgcatggcagcataaggccccgctgcagatcgactgccttcagaaacaaaaagtcccggcgcaaaggcgttcccggagtggcagcctggcctgcaccccagctgtgctgcccctgcagagccccagcagcgagscacacccaggtcaggggagggggcttgggtaccaggggcctcactggctcttcaccaggaccctgtagagtgagaagctgaggactgcggccacggcggccccgacaacccccagcagcccccggagccagaaggaagagggatgcagctctgcgtggaccaaatgtgggaaggcggccatggtggcgagctgggtgaagatggtggtgctgggctcggctgggccagcacaggagaacggcacgggagcgggtagccggtgcttgcggcaaaactcggccggtgatgggccagacaccgcgacacttcgggcaggtcggccttggaggagacaaagaggcagggggtctgcccgtccatgtaatggtgcttgtagacgctggcacaatgtgcaaaggactttgggtcactgccatcaaacatcaagcaggcaacgtcacaggtggcgtccagcgatgtggccagcagaccatctgtgcccacctcacagaggatcaagtacttctcctgcccattgacctgcaccgtgtcgatggcgtagccgggaggctgctccctcgtgtcctggtgccccaggccgcggccgagaaaggcctgcaggaaggcagacttgcccactccacgggcccctaccaccttgcacaggaggamgntccgctgcgtctgtcccttctcctggtccagcctcttctcacgagtgactgtgatggcatgggcctggtcctgctcacagagggtggggtagcccaggtagcctaggtgtccaaggcagctccggacgtccaggtaggtcaccagggtccactggcagaggtatccgtgcaggggcaaccggccggcctctgtgcggactgtgcgtgggagctcggggccccagggcgctgctgggaacacactgaaaaggctttgcagctccacgggcgagagggcgccgtcgcggtcctggtcgtgcttctcaaacactctctgcacaaactggtagccaaggtggttgagctccgtgctgcagccggggggcacgtggatcagaggggagagatagtccgcagtcagctccagggcatcgctgtagccgaagcgccgcaggatggtccaggtggtctcgtgccggccgcgctggatgaagagcgtgttcaggaagaggaaacctgcaccgagacaaagcagggggagcaccaggcacagccccctccccacactccccaggcacaggcgggcacccggcctcaccatccagggtcagcyggtcctcccgcacgccgcccgccacattcctgcacaccaccgtcttcacgtcctccagggcctgcggggccagggggtgccyaaagcaggatttctggaaagcgttgagctcttcgtcactgagcgcctggtccaggtcctgatctgagagcctgaagatgcgcgtcagcgcctgggcgcacgcgggcctcaactgcttggcctcagggtcatagaggggggctgtgggatgcaggacggccttctgggcgtagtagaacagctctgagatgttcctcaggttcttggccgaacactccacgcaggtctcaatctcgggaaactggctcatgatggggagcacggcctccatggagctccccgaccgcaggtctgacttgttgcccactaggatgatgggcaccctgggcccctgcgtggtccccccattcaccagtgggatccacttagttcgaatcttctcaatggtggcctcctcagagacgtcatacaccacacacaccacgtttgccttgtggatctcctcccgcagctcctcgtccgtctgctcggcttctgagtagtccacgatgtgggtgggcaccttctccggggtgacgtccctcgtgcc

SEQ ID NO: 1894 - DNA, 641 bp, Homo sapiens
ggcacgagtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaaaaaaaaaaaaaaaaaa

SEQ ID NO: 1895 - DNA, 2163 bp, Homo sapiens
  misc_feature (2118)..(2118): n equals a,t,g, or c
  misc_feature (2136)..(2136): n equals a,t,g, or c
tttgctgtccggctgcctakggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggyttcattggtggaatcatcgttgtggttatgcgaaaaatgtcgggaaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaagaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattayatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttttcctaaacaaagtttttacactgagcagatgctctgtcatgatggcggttgtgcaattctggtatcctctaaatttgtaagcattcataaaaaaaaaaaaaaaaaactcgagggggggcccggwcccaattgccctatagggagtcgtattacaattcactgsccgcgttttacaacgtcgngactgggaaaaccctggngttacccaacttaatcgccttgcagaa

SEQ ID NO: 1896 - DNA, 1312 bp, Homo sapiens
  misc_feature (1168)..(1168): n equals a,t,g, or c
ttgcaggaattcggcacagtcacggcatcccactctgttctgccgaggacgtgaatctttcctttgttcagtatatcccatgctgtatacactacctgcctgtcagtcattcagtagcggcctatgttatcagattggctgatcattgtattgcagtgctatgttcaggtaacacttattttacttatagtggtcccaaggtgcaagagtagtgatgctgacatattattataacttctattttattattcttattgttaatcttactatgcctaatttataaattaaacttaatcataggtatatatatataggaaaaacatagtgttatatagggttcaatactagccccagtttcagttgggggtcttggaatgtgccccccacagataagaggggactatattcttatagaagaagagtttgattttttaggacgttatttcctgttcaaaccattgacccactctttgagataagttattctgaagctttcatataagtaaaagcaattaaattttgccaccagcaccatcctcaaccattctgaattataaagtgttaaaattaagaacaggaagaatggaagtattcaataaaaaatgaagtattttcagttccatattgtcatcaaataagggtgggaaaggcaaaggagaaaatcaataagtatggagaagaaagaaatgagtagatagaacaaaaaagatgagaaaggaagccatattgaagtcaggagagagtgcagagcaagaaaggatgggcagaaaaaaagaaaacaagaaaggagtttaatgagtgagtagaatgtgctcttgttgcattctactgccagtctaagccatggaatagttcactattctgggaagtattcttaagatcatcagtgaccttcaggtcatgaaatctaataagcattctttcagacctgttcttatttgacctctcagtggtgtttgacactctcaaccaccaactctttgtgaaacctttttttccctgaaagctgtgaggtcgtgctttctcggttctcttctcatgtctctggtaactcctgctttgtctactttgggttttttgttttgttttgktttttgktttttaagagttgggatcttgctctgctgcctaggctggagtgcagtggcgcaatcatagctcactgcancctcacactyctgggcttaagtgatctacctgccttggcctyctaagtaactgtgttcatttgacacagtttaggaactaaagatcaggtaaaaccagccagttcctgagctggaattgaatctgttcagaatgtctgggaact

SEQ ID NO: 1897 - DNA, 1966 bp, Homo sapiens
ctgttcctggcggagcgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatggraacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaaaaaaaaaaaaaaaaaaattc

SEQ ID NO: 1898 - DNA, 1726 bp, Homo sapiens
ggcacgagttgaggaggagggagcgcttgaaggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctgtatgatctcctgtctaaacattcttagagtattatatttactttggggactattggccttgtctgctttgactcagattataggatatataacctggttaatgtttctgtacacatgatggccacctatgtatatacacttgacttttcagggtctctgctggggatggaaaaatagttcattagccaaactctcctaaagtgtggcaatggaggcagtctctcagattgctggatttgtcaccatcttccaagggccattcaagatcattacatgctacttgttgcaccagagattgatttttctgacactccaaatgttaccatatacttacatcagttccctccaaatgtcactttccaaattcaaattcagcttctaaagccaggccatattttcattctgtgcttagtaataagccctaagtctcacccttccccaccgcccccaggtctatctatcagtaagccaattagggacaaattctctaacttatctagaacacaaacttaattcctcatcttttccaggtccctgcacattcctggcctcccaccgttactgtcataactggcaactgaatgtccaaaggagaaaaagcaaagcagattgtgccagcacgtctcatttgttatatatcatgcttatgcaggcctttgtaaggcctgcagtaaaaccaatccatggctcactcatgttttaaacaacttacctattcaaactattatgaatgaatagttaagagatacattttggtatgtggcattgggccacacccaccaactcaaggatgggcacatagtgtaaatagctggcaaaatagctggcaaattgaagggcgctttttttttttttttttttgagggagagtcttgctctttcgcctaggttgtagtgggtggtgtgacatggctcactacagccttgacctcctgggctcagggatcctcctaccttagccttccgagtactgggccaaggagtctgtgcagtagcatcaagagcctgtgccttacatcaacacctcgggtgaagtagagacttgcacagaaagaatttccaagcaagctaaatggttacagaggcacaaactactgatcttctcaatgactatttattggcttcctatttcttccagtctgcagttcaacccctttttcatgggtaaagtgccgacgtcataacaaggtttgagggaggcactttcaccgtgtgaatgcccagtcatcacacttacaaatgacaaaaggattcaaaccttgatatagtctctatcctactttcttactatcacttaaattactcatggtatttataaccacttacgtaagtctattgctaaaaccaaattataggtcaggtgcagtggctcacattcaatcctagcacttgggaggccaaggtgggaagactgcttgaggctaggagtttgagaccagcgtgggcaatgcagtgaaaccctatcttgataaaaaaaaaaaaa

SEQ ID NO: 1899 - DNA, 2006 bp, Homo sapiens
ggcacagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcaagtgatcgagatcggagtggctacatcttcttttatatgcacaaggagatctttgatgagctgctggaaacagaaaagaactctcagtcacttagcacggaagtggggaagactacccgtcagscctcgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgscatggagcagcattaccctaatggattgcaaccaaaactttaaacaagtagaaagataatatttctccaattgggactccccagcaggaatacttagggataaggaagaatgctagcatctctgtctctcaracatagggaggataagaagagtgktcttctggkaaagctaaaattctggaccactgaagctaaaagccctattgcaagtatgaaattaagtacttgagctataggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaaaaaaaaaaaaactcgag

SEQ ID NO: 1900 - DNA, 1175 bp, Homo sapiens
ggcacaggtcttcacaacagcagaggcccaggcccgggtacagctccgtagtctcctgggacatggtccgaacccacggatggctgggggtggtctgaaaaggtcctggccctggggaggtggcttcctcgctgctgactgccgagggggccctggcctggatccatgctgggcagaagcagctggacactgaccaggaccccccagggccggagaaccaagcttgacagccccccagacaatacacagagcctggacccagacgagacctccccacccccccatctttgtccccaccaggacaaagagctcttgccagtcttcccactgggccatggtgccagctgtccccctagttctcctgccagggaccccaaggctgggaccaccccgccagcctgatgccccagcacccactctgcggcaacttttctgccacggcagccccctctagtggacattggagccctgccgcggaggcgggggctggaggcttgtggagcccttcccagggtctcctagaccccggtggagcagaagggcgggggccggcccaggtcactgcccttctgcacccacagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtgaaaaaaaaaaaaaaaaaaa

SEQ ID NO: 1901 - DNA, 1402 bp, Homo sapiens
ggcacgagacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttgggttcataaggtgctcggcaaggtggctgtgggaattttttttttttggtccttctttcctcttaacgtaaatccaccaccaaaattattaatcctcttgaaaagaaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcaaaaaaaaaaaaaaacaaaaaaaaaaaaaaaa

SEQ ID NO: 1902 - DNA, 1221 bp, Homo sapiens
  misc_feature (1220)..(1220): n equals a,t,g, or c
ggatggcgtcccgcaaggaaggtaccggctctactgccacctcttccagctccaccgccggcgcacagggaaaggcaaaggcaaaggcggctcgggagattcagccgtgaagcaagtgcagatagatggccttttccacagcccctggaacgtgcttaggatgcataccagggtacaagcttaggaagtgtgggcacccaccccagcccatggacctgtgtgctccctgcgttgagcctgagatgccatgcttctctctactctctctaccactgtgggatcccttggtgattttggttttctgttagtaaacttctgtgtttgggatctcgttgtctagacaaataaccaccctcatccctgccatctgcccagtgcttcacaccctcgctacacacagtgtggtcctcctgtcaggtgtcagcatcactggagaatattagaaatgcagagtcttaggccctatcccagatctaatagcttcaaatgaatcttcatttttataagatcccgagagaccctgtgcccactgaagtttgagaaatgctcccaacttattactgccactccacagctgtcacctcctcagctccacccaacttccggagttattgtcatcaccatttcacaagtgaggaaatgtccattgagattaagaggcagagagtaagagggactcagatcgagatctgctgccttccacccagggtccctgaaataccttggcctgactttccctgtgggtaccaggcaaaaggacacttcgaagagcttcactgagcaatcgacctgcccaggcctcctgagacrtgcaatttamcawwactgtgggtcacctcatccacacctctaacaaagtcacaaggggaactggagaaattcaagatgccagcaaagaaataactgccgggctgaaagacttcataattgccagatggctgaagtgttcagagagtcggagctatggagaagggctaattgatcttgacatgggctaagaaacaacatyacacctgcggcaatgactgcaagcttttctagtcccaagagggaaaggsaaaattctgctcccaacaatgagagagaaatggtctccacccccagtcagtggcaacacagagaggaggtacaagcacaggctgatctgcttgtgaattgtcaccacacttaactagtcagctagcctggggaaagttctgatttattctgagacgtagttnt

SEQ ID NO: 1903 - DNA, 942 bp, Homo sapiens
ggcacgaggggcttcagacttgagctctgcctccccagatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggctgttgttacagaaacaataaaccctgatgggcatggaaaaaaaaaaaaaaaaaaa

SEQ ID NO: 1904 - DNA, 2103 bp, Homo sapiens
  misc_feature (456)..(457): n equals a,t,g, or c
gttggtgctgccatccactaaggagaccttcaggttcaagctaactccaaatcctacgaagcccttctcttctgctctgtggctggcagcccagctcttgtaacaaaggcatggaaattgacagcagctatagccacaatctgaggaatggcagacaagaaacagcagagtaggcctcaaggagtcactgaagaacccagggctcctctttttagctcagagccatttagctgaaattgatgagtggatggtctttaagtcattctcccttgattggtcagtggcctgtcacagataactggcttgggagctgcctccatgctcctgagggtcttcttggtggttgtcacacagtgtggctgctgagtggggacaggctccttgtgaatggtgtgctctgtctaacctctctcattcccgccctcccgactcaccgacgtgcatgctgcccacatnncccctgcccaagacaccccctgcacccccatctgctcccctcgtgggcagcaggtgcctatgccttgtctacctttctgctcctcatccctacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaaaaaaaaactcgag

SEQ ID NO: 1905 - DNA, 1255 bp, Homo sapiens
aactagtggtatcccccgggctgcaggaattccgatacattggtctttaaacccaaaccccctttaaggcatgttggtctcaaggggatttgggattgaagcrcagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggrccatgtcctaatawgggtggttttaagttgttgggccaaaaatcctttaaagacatacgaaacatctgccaactttttagcaaccccacagagcccgcgamamgctcgctttcttccccgccctgcccctttagtccccgctctggaagscccaggcagtttaggtgtaaatasgtatcttttatggtttccaaatgaattatttgtgtgagagtaattaaatctgtaagaaaacctgttgagattcttcacwatgaattatgacttctacaacatgtattttagcaaaaacacgatgctggcctccactggatagctcagtatgctgattgccagtgatagttctgtacgcgttaccaacagcgtctttattaaccctctcccacatccagtggaaatcattgctaggcggtatttgttggttggctgttagctttgctttatgatttcatgtttcttttaaaggttgttttgcatgttgaatattaaattttttttttctgtgtmaaaaaaaaaaaaaaaaaaattctcggcg

SEQ ID NO: 1906 - DNA, 1642 bp, Homo sapiens
  misc_feature (1369)..(1369): n equals a,t,g, or c
tcgacccacgcgtccggtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgagtgagtggaggcagccttcccctctgggaagcttagttcccactggggcggagctaagggccgggtgccatgcaccctgacacggcttcccccccttatgacccagaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggtaagtggctctggctgggcattttctgtctgcaggcagggcgagctggcctaaagagtggtgctctccctgggggccagaggcaatgctgtgtcagctctgcgtgcatggtgaccagcatggggaggcagtgtggtctggcasaaagcacaggctgcctagctggangcacagtttccttgttggaaaatgggatgagcccctgtgcaccaggtagtgggaggatgtgaggtttmtggcacatagccgggccttgtcatttaaagccattgtaaataactgggctactctgggccaccctgcctataggatagccctgctctgtctatggagcaagcagctgttttactatataccgttgctctaataaacttggtttcttttaaaaaaaaaaaaaaaaaaaaaaaaactcgagggggggcccggtacccaattcgcccg

SEQ ID NO: 1907 - DNA, 1621 bp, Homo sapiens
ggcacgaggctagatagtgctatgaaactaattttggcaaaagactttgatgaagatagaaaatagtaaaattgatggaattcaccaatttggtgatattgacaatgtttcttaagctaggactttcttttcctttttggtttgtagcctatgatgttggtttacttggaataaaatctagtaagaattcatagaatattgaagctaaaattttacttagacatccctgtcctagctctttattttctgataaagaaattgagacatagaacatggcacacaactcaacatctaggtttagcaaatgtttactggaaacctgtaaggagcctggtactgtatttgcagaggcatttgggacacagagctgtagttcccgacctggagaaacttagccatactttctgactttcatttcattgttctttccatcataccgtgctgcctcccttctcctcttccctctaactttaaataataagctgatttaacttcaaagagaacatttcaattttaattcctagtatttaggatctctcgttataacttaaaaaaattcgacactaatcttagaaataactgctgtttaccactaaggaaagatagttattctccatgttataaatggcttcaatatactttagggttctgggtttcccccagcattggcatctgaaaaagaaagatgtcttagagcagcaggagaagtatgggatacatgagctgttcattcttgcctgacatgaactggcctgtagaggatgagctgggcatttgggatcaaagtttagagaaaatctgaccagaaaagaaatttcactttcttgggattcacaggatcatagagtcttaccaacgagagaggcactcaaagaatgtgaaggttcagttgattattttttaacttgggcttggctgtagaacataactcttcttcgtatgactttttcatttcctggaattctcctaacaacaaaacaagaggcttagtatccaaaaggaatggagtaaacactgcaggcaagcaggagcacattagaaatttttacctattctttattagatagggatttagtagtcatcttaaatggcacgatagtttgaatgcccacacttctgcatgtggtctttctcttggttcattttttaggtatcccagtggttcttaaatataatatgtaaagggattactgtagtgcaaggttgtatatacatatctgtatgtgaattttagaagagtttaaaaggattttcttaatgttaattctgtagcatttggctacaggtgatgttacaacccatccccaatgtaagacgttagtactgtaatgacgcacttgtcccactgtaactaagtagctggatatgttacaatggaaaagggagaatgaatgattgaaaatagatttttattcaagaggaaaagaatcattatttcctagtttctaaatatccttcaaaatgagaagaggctaaagacatattaactaagtatatcagcagttgtctaccaatattatttattctcaaaggacatagtggttctttttcctaagagaagatagtacaaactatttaaatgtagacgatttcctggagctttgaaaaaaaaaaaaaaaaa

SEQ ID NO: 1908 - DNA, 1978 bp, Homo sapiens
ggcacgagtttgcacatgtgtcccagaacttaaagtataatttaaaaaataaaaataaataaaataattagaacaaagtccagcagtatagagaattaggtaataatcaataggaacagacaaatctaatgttgaaatagaataatagatccagaaattaattctaaagtcttatttatggttctttaatgtgtccttgatattagcttgcaattagctccatcaagtgatagtatccaacgtaaaatgggcttagcaatttcttgcttctcatgctgcttttatatctctcttctttcacattcttggagtccccaacaacagggcagaggctgaagggcacagatcttttgtgtcgtatggcttggcctccattgaagtaggtgagggtgaccatccctggtacggaaagacaggtccgggcaggccacagtctggctctcctgcctggcttcctgggaataattgagcaattgctctgtaccaggcggggttctgaatgcttccacgtcccaatttcaatcacttctgcaaggtgacgcagctaggaaagatgtgactcaggccactctggcatccaggactcacctcctcttctgacctctcgtcagcctgctgtattagctgggccgcccttcccatgttgacctcctcccatatctgagcgttggcctcacaggcagcgtcatgaagctgccaccatccctgtccccctttggttcaggccacagggatgcctggagctgggaacggccctgcgtagcactgactgcagagtcttcagtgcgtgtgtctctgtctcctttactgaactgtgagcgcctaaggaggggccttccatctgctagtttatccctggaatgtatctcaatgcttggcagaggataagcgttacatgttggatacattaattgatcctaagattctaagcactaaattttacgagaagtagcaaaaatgacctgaatgtagtcgcactgtatcttttcaatgatccaaacagctgactccctgggcttacgccttcataacgctggaaccccctcccgcccgctttgttcctctccctcttgcagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaaaaaaaaaaaaaaaaaaaa

SEQ ID NO: 1909 - DNA, 932 bp, Homo sapiens
  misc_feature (929)..(929): n equals a,t,g, or c
  misc_feature (932)..(932): n equals a,t,g, or c
ttccactcctgctttttgttaccagctgtgatgtttggcaagttaataaacctctcaaaacctcacctgtaaaatatggataacagtacaataaggtttcakcaaatagtagatgttgtcaataatgctttgttttctttggaacatgataatcttactagtggcttcttcggcctattctggttgtgaccttgcccttcctggaacttcggcgttatgactgtwcttaactgctgaagratggctgratgtctggaaatggraaaatctgtsctgtggatgaaatcttattaatagatgtggragmcactaattagamcaccacaacttaaaagagtgtggatgaatgcttaatgtctctttaagtcatggagatggtgttctgggaaagaggtgagtgtagtgggggtatgatggcatctgactccttgttacccacttcctgcagctagatacactgtcagatcctttggcatccggagaaatgaaaagattgctgtccactgcacagttcgaggggccaaggcagaagaaatcttggagaagggtctaaaggtgagcctaatcccctaatggagtgatattgatcagcactcctttagtaacacatgtagataagttacatttaatgttctgttctttggtgtcttgatatttatttacttaagcttctaaaaggctttttctacaatcagcagggttaaactgttcttggtggtttaaaagatgcttgaggctgggcacggtggctcaacgcctgtaatcccaacactttgggaggccaaggcggttggatcatttgtggccaggagttcgagaccatcctggccaacatggtgaaacaccatctctactaaaaaaagataaaaattagccgggcttggtggcgggstcgrgtagtccaagcaagagagttccagttacggtgngcn

SEQ ID NO: 1910 - DNA, 3052 bp, Homo sapiens
  misc_feature (2994)..(2994): n equals a,t,g, or c
agcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaanaaaaaaaaaaaaaactcgagggggggcccgagtacccaattggccctagaagaggcga

SEQ ID NO: 1911 - DNA, 1280 bp, Homo sapiens
ggcacgagccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttatatctttcatatctttatttatcatggttttacttttaacctatttatgctttcatatttaaagtgggtgtttagtgggcaacatacagttgggccttccttttttatccagttaacaatctctgtctttttactggggtatttagatcatttacgttcaatgtattgatgtttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcacttactgtataataaaataatcttacagtaaaaaaaaaaaaaaaaaaaaaaaaaaaaaaaaaaaaaaaaaaaaaa

SEQ ID NO: 1912 - DNA, 3620 bp, Homo sapiens
catatgctgcctgccctgcaatctgcgtacaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacctcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaagtaattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgtaaaaaaaaaaaaaaaaaa

SEQ ID NO: 1913 - DNA, 1896 bp, Homo sapiens
ggcacgagtgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgaggcagtggaggaacgggattttccaacagaaaccattaaatttggtcctgaacgcatgtatattgattgctgggtaaaaaaacacacctatgacacctttaaggaagttcttggatcagggatgcagtaccacttgcagtcaaatgaattccttcgaaatgtttttgaacttggacccccagtgatgcttgatgctgcacgcttaaacgatgaagattctcgttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcttggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttcccactgaaaaaaaaaaaaaaaaaaaaaaaaaaaaaaaaaaaaaaaaaaaaaaaaaaaaaaaaaaa

SEQ ID NO: 1914 - DNA, 1361 bp, Homo sapiens
agcatttggtggacttctgagcggtgtccaccttttagctgtgatgaacggtgctgttgtgaacacttgtgtacaagtttcagtgtggacgtgtgtcttcgtttctctcgggtatatacctaaggtggaatcactgggactatggtaactgtgtttactcatttgagcagccgccagcctgctttcccaagtgtctgcaccatctcacgtcccttcctgcagccttgggagttctgatttcgccacatctttgccatcacttgtttttctctgactttttgtttccagcccatgttgggtgtaaagcagtgtcttgtggttttcatttgcattttcatgatgactgataatgttgaacatctttttttgtctttcttggcgatctgtatttcttctttggagaaatgtctattccgattcttgcccacttttagttggattattgtctttttgttgttgatttatgagttctttacatcatctagatagaagtgcttcctcacatatatgattcgcaaatatcttctcccattctgtgagatgtcatttcactttcttgatggtgtcctttgaggcacaaaacttttaagtttttacgaagtccaatttatttttcttttgtcacttgggcttttgctgtcatatgtaagaatcttttgccaaatccaaggttatgaaaaagaaaaccttcaaaagtttttttattttagctcttttatttaagagctaaaataaaaattttaatagctgcatgtggtgtgaagtagggatcccagttcgcccttttgcgtgtatctgttcgttggcccagcaccgtttgttgaaggctgctctttcctcactgaacagtctcgacattcttgtcaaacatgagttgcccgtaggttatgagtttattccagaaccctcagttccactgcaccgatgcgtgtgtctgtccttgcgccactcccacactgtcctgttaccatcgcattgtaagtcttaaaactgggaatgtaagtcctttgacttttttctaatccaatactatgaacaaaatagatggcagatgaaattgaaaatttcctagaaaggtgcaaactactcaaactgattcaacaagaaatagacaatgtgaatagatatataacaagtgaagaggttgaattagtaatccaaaaacacccataaagaaaagccaaggaccagagagcttcccagctaaattctaccaagcatttaaagaattaaaaccaattctcacaaactctttcaaaagactaggagagtgggaaatgcttctcaattcattttatgagaccaatattactctgataccataatcagacaaagacattgccaaaaaaaaaaaaaaaaaa

SEQ ID NO: 1915 - DNA, 643 bp, Homo sapiens
ggcacgagacaaaacaccatgacacctattttcaaatgcttcccagggcaaccccagcgacctgcagggcagtccggaggtggggcagggtgggaaaggaggcctcctaacttccaatccaggacgctctccatgttgtctgaggcccttgtgatcccatctcttggcttcttcgtctcctctctctgttctgaccagtggcctctttcggcccagcccagctcatggctctcggcggccttcccaggccccgcttttgacttttggcagcctcttcaggcacagaacttgatctccagtcggcctttgcaggcccggcctcctgcctctcgaaggcctgcacgggcccggcctcggcctcggcctcggcctcacagcggactctccacgcccagctagctctcgcctcactgcggcctccccagtccaaagctcctgcctttcggccacttcggcaggtccagctcctgcctgccagtggcctctttaggcccagctcattctcacgtcggccattccaggccccgtgtttcccttccggcagcctcttggcctctaatttgtttatcttttgtgtataaatcccaaaatattgaattttggaatatttccaccattatgtaaaaaaaaaaaaaaaaaaaaa

SEQ ID NO: 1916 - DNA, 1323 bp, Homo sapiens
aggcccagcaccacgggcctttccccaggccagggggaggaccacctaaggattcaagggcagctcctgttttcttggttctgtgaacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggccyttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggwmaaaaaaaaaaaaaaaaaaaaaaaaaaaaaaaaaaaaaaaaaaaaaaaaaaaaaaaactcgag

SEQ ID NO: 1917 - DNA, 2083 bp, Homo sapiens
  misc_feature (1781)..(1781): n equals a,t,g, or c
  misc_feature (2057)..(2057): n equals a,t,g, or c
ggtgtccttctaatgccatctctgtagaaaatgtgccctgtaagtcagtttcctggaagctcttctgtgtgttgtcccttctccagcagtgggtcgattgtcagggagcccaggatggaagctaagtgcactggtcattggttgttctttcagtgcccttcagacagcccttgccctggtggtcttgtgccctccctgtctgtttggtgcctcttttataaattagtgatgacttcaggaaatggtcctggatttcaaatagctattcctggagacattctaattctgtggtttaaaccttaaaacaaacaaaccaaagtaattccctggatattggtggctactggtgtgaagagcatggtgcggcgcctgttacttggatgagctttgatcaaagaatggcatcaaatgataacagacattggaggtataagtgattacaaggagaatcatagatctaaataaaaatggaatggtggttaatactttaattgatcgagatgatacagcaatatttttattcatatatcagtacaatatttaacttttaaaggaagtgatattcatcttagcagaggtctcttagcaccatatttgcaacattggatgttatccattgagccttgttttggggaggaaaaaagacaccaactttcttgagtaaattgttctctgaaggtgttttacacaggaatacaaatttgcctgaactcaaaagggtcttgtttacagtactttaatcttgtttttcacttcataagccctctgtaaactgaaatacagagctacaggcaaacctcattttattgcacttagctttattgctctttgaagatactctgkttttttttttttattcaaattacagatttgtggtaaccctgcctcaaacaagtctgttggtgccatgtttccaataacaggtgctcactttttgtctctgtgtcacattttagtcattatctcaatatttcagactttttcattactggtatatctggtatggtgacctgtggtcccagatctttgatgttactatkgtcattgktttggggccccataamccatgcccatataacgtggcaamccttatcaataagttttgtgtgktccgattgctycatgaaaccagctgttccccctctctctccctcttctcgggcctccctattgcctgagacacccaatattgagattatgccagttaataaccctgcaatgcctctaaatgttcaaatgaaaggaagaatctcatgtctctcactttaaataaaattctagaaaggattaaacttggtgagaaaggcatgttgaaagccaaaatacgctgaaggctagacctcttgcaccaaacagccaagttgtgaatgcaatgaaaagttcttgaaggaaattaaaagtgctacttcatagaacacatgaataataaggaaaacaccttatttctgatatagagagagttttaatggtctggatagaagatcaaatcagccacaacgtttccttaagccgaagccagagcaaggctctaactctcttcaattctctgaaagctgagacaggtgagggagctgcagccaaaaagctggaagctagctgagggtggtttatgaggtttaagaaaagaagctatctccgtaacataaaagtactagacgaagcagcaagtgctgatgtagaagctgcagtgagttatccagaagatctagctgggataattgataaagctarctacactaaacaacacattttcactgtaaaccaarkagccatctyggaanaaagatgctgtctaggactttcttagctagagagtacgaggcatcgccttttcttaaagcttgaaaggacaagctgacccttggtaggagctaatgcagctagtgacactaaattgaagttagtgctcattttcccttctcaaaatcctacggcccttcagaattatccttaaatctactctgcctgtgctctaggaatggaactacaaaggctagataacagcacatctgctgacagcatgatttactgactattttaagcccactattaagacntactgcttagaggcaaaaaaaaaaaa

SEQ ID NO: 1918 - DNA, 917 bp, Homo sapiens
ggcacgaggctttccggtacaggatacagctgtgcttctcctactttgtatttgccatatacggatagatacaaaacctcatgactgatttttccctatttattttgagtggctctgtataccattttcatgtattacttcatttttctgtttttcagttatgttctctgttttcgtatatttttggaagctagttctaagtcatgttttgtaggaaataagcaatcttaaatacatgcataggggatttctttcttctgaggatccttaatttcttctatttttaagattcaaattgaatgattaatcagtaacagtttatgttttaaataaaagtctttaaaatgttaaatatcagcctttcatttctgatatttggtctttgaagaggaaacataatgcaatagtaattcataatagtggagggttctttcctcacatccttgaaagccaccagtcttattcttcagcctggctcttgagctattgctgtattaattttaaataggttgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcagactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcattgttgctggcgattccacacttacatctaaaatttcctgattttttaagaatgacaataaccaatttaaaaaaaaaaaaaaaaa

SEQ ID NO: 1919 - DNA, 1014 bp, Homo sapiens
  misc_feature (820)..(820): n equals a,t,g, or c
cccacgcgtccgatttgagatatttccttttgattcagacgtaacactgtgctttcaagcttaacatcctattattttcctatatatagctagtgtttatgaaagtttctctactccttatttttaaatccatataaataaagcatttattggatttatactgaggttgaattaaagaagtgtaagtttatttttagcatcgtgagaagtgtctcacttaaggtagtttttaatctggttgtgtttgcaatgaaacaatattagacagttttataattgatttctttctttttcctaccatttcatcagcaagtcccttcagctctttcaaaataaaccctgaatctgatcattgtggtctgaatcactattatattttgccagaactgctacaatagcctccaaattcttttttcctcttttcttacactcaattaatgaaaattttaccttacccaagtaaaatcagctatgcccagtgatcttttaaagacmaatcagattaacattcacctgctgaaaacccttcagtgaatttctgtctcttctagaataawwtctaaagtctttattgtggcctccaatgctctatctagtctggcccatatctatctctaactgtatctttgatcaatctctatcttaatcattgtgttccaggcacactaaccatctcgctattccttgaatagcatatttctgtctggaatggtcaactaacagcaaagaggacagtgtggttggataggaatgagagagggaggaagagggtgatgaggttacagaggtaattaggggaaagattatatggtcttatagnccgtagtagtacttttagatttttctctgaaaaaatagagagccattttagggttttgaacaaaggactgatatcttccacttgccatttaaaaggatcattctggctgttgcattaagaatgactatagaggctgggagtggtggctcacacctgtagtcccagcactttgggaggccaaggcgggcagatca

SEQ ID NO: 1920 - DNA, 1720 bp, Homo sapiens
ccacgcgtccgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtaaaaaaaaaaaaaaa

SEQ ID NO: 1921 - DNA, 1730 bp, Homo sapiens
  misc_feature (455)..(455): n equals a,t,g, or c
gggtcgacccacgcgtccggaaggatggaaataggacccttgagccgattactccgtgatggctcagactgcatgcaaagactaggatggggctcttgctctggctcagtgttgggcatacttcccctcagaaggcccccgccaaagagcttagattttggcttgggaaaaacattacccctcttcagtaaccctgaagctctgtatttggtatttgggattcaggtaggtcagctgctcatgttgmctggcccaagtgtgtaagaacaaacagtaatgccagtcattttcccactaagatgttccagtgggaaggggggctggtatgaaaaagagaatttttttttctctgtgtaatgataactttgttcacgtagtaagaattcagttcttactattggtgtgaatagggggtaaatattatttttatttaaaagcaaaattaaatactttcntgaacctcatccatgtttgcaagtagatgtctactgtggttgccttttttcctcaagagaatattttaataaacttgtaagtaattttgttacatttttctgtctgcctgtgtactatgtattaaaactcacatgggggctttcatgataaaaagataaactgttaagcagttggaaattttcagtgttcttccagtggacacctgccttggggcaggagcttctttgtagtcattattgatagaatggggtcacacacattgtgctcctgcattaagggcagctccaaggtttggcatgagactatgcatgtgtgtggacacggaggtttctcagtgagaaagagtcctaagacagtgaagtggaacgargccttaaaaatcatctagtcagctgacttccagtttcaggttctcaggctccttttggtattttaggaagcccacattggactagagagagacttcagaccaagatatcatgtttatgttcttttagctagaattgtgttaaggcaatgactatctcctacagcttagaagttctgaagtacatggccaggagcggtggctcamacctgcaatcccmgcactttgggaggccgargcgggtggatcacccgagctcaggagtttgagaccagcctgggcaagatggtgaaaccctgtctctactaaaactgtgaaaaacacattagccgagcatggtgatgcacgcctgtaatcccagctacttgagaggctggggcacaagaatcacttgagcctgggaggcagaggttacagtgagccaagatggtgccagtggactccagcctaggcaacagagcaagactctgtctcaaaaaaaaaaaaaaaagttctgaagtacagttatatatgtatttgattaatacaaaagtagagaagttaatcactccttaaaaaatgcagtttgggaggccaggcacaatggcttatgcctgtaatcccagtactttggaaggccgaggaaaggcggatcacttgagtccaggagtaggagaccagcctgagcaacatggtgaaaccccatctctacaaaaaatacaaaaattagctgggtctggtgacgtgtgcctgtggtcccagctacttgggagactgaggtaggagggtcacgtgggcccaggagattgagacttcagtgagccatgattacaccactgcacttcagcctgggcagcagagtaagaccctgtctcaaaaaaaaaaaaaaagggcggccgctcttaaaagatccaagctttacgtttcc

SEQ ID NO: 1922 - DNA, 2018 bp, Homo sapiens
  misc_feature (672)..(672): n equals a,t,g, or c
  misc_feature (1609)..(1609): n equals a,t,g, or c
attggctacaaacccactggtataagcagcagtgtgccttctctctaactgtggacaagtcgggcatgtggcgggtgaggagcccccaaataactcttgaactggaaaataactctttagctatatactggcagaatatttgaacaactctagcaagaaatgtcagtttagggatgcctcctctaaatgggggcttagaatataacattttgcaggaagtcctttctgatacatagctgactagatgaaggaccagattaacaagttcatgagttgtaaatataaaagttgtgtaccacgataaaaaagaaaaagaagtatggctgcactgttgatggctggtcaaacagcccccaagaatcctggggtgactccaatactgccaccttttctctgtgggtgcagttgcctgcggatgtgtgtgcacatctgtgcctcggtatgcacactcgagatgcccgctctcatagacggtgcagagcgtcactgcattcctatctgattaatgtgaccttagtgttgtagatacactgtgtcactttcatcctccctcctccccacaaaagatgccacgagaactcgtgaactgtgataagcaatgaacagaataactgttgaagaagcacctcatgaacctccccagagaaacgggatggaggagcacccagggtnctcttgctctcttgcctgcgctgccatttccttccagcctgggtttctagctctttggggagattccccgttttgtggaatgctttctgtgtttcctacttctggatgcctaaggagtggccagtcatactcctggctgaccactgccaggcaccgtggttttcctcactgaactcaaggagtcaccctccgtggggaggccacactcacagctccaggcctgccatttagccttggggcttggctgtaaagttgcccaagaggattacaggagctgccagccaagtttaatttggccaccttagagaactgcagcaaggccctatcagcttcccattagacaaacaactgcatttaaattaaataaagtttgcacctctagggagtgctgacctgaaaataagaaccttctgtctgtgattatagagtacacttgcttttattaattgctgattcttagtttacaaaaaaaaaaattagaaaagcattaccatttactttccaaggggcaagagattctctacaatacccttcccccaaccctctcctcaaatttccaaatcctaaatactttgaagaaatttgtgtgactgtttaaaattgagtatttccttctaactattgtcttttgaaaagggatggttcaccaggccagtgatactctatggactgcattttgggacctctaccccagcaaggatacaggttcctggggtcttgaagatgggaaaagttgtctcagaatttacccaaatgtcgttctcaccataaaagatatacttgtagaaatgagaagcttcagtataactcaaaacactggacgcagcaataactataaacattttaatttcaaaaacaaaggtgtgtgcgatgttgtgtgcacagtaagggttgcggggcttggagaacaagcacgcgtccctgtgaagcccgcagngtgctggcggcccaccaatcgcctggactacagtgaggagcattgtgtgactccgcggtggatttccatgcaccgaatggactcagtttctaaactcacatcctaacgtatcctggcttttcacagaatactggagacatgactgcatgcatgatcacggttcttgttgtgaagctgccaccatgttacgcttaacagctgcataaatattataaagaaatagggttttcttgacacttagatttaaccttaatgcatctgcccagctgatggtatcagacgtgctgctgttcatttctttttcatggtaacagtaatgtataaagtgccgatgatgtaaaaaaaaaaaaaaaaaaaaaaaaaaaaaaaaaaaaaaaaaaaaaaaaaaaaaaaaaaaaaaagggcggcc

SEQ ID NO: 1923 - DNA, 1020 bp, Homo sapiens
ggtggaaatgaaataaatttgtacatgtaaagcacaagaacatggaaggtgcttactaaatgttacttatctttactttctctgccttggtcctctcatacccactcctgattttaggtgattgggtggaaatggccattgaacatcatactctactaacaaagaccatttgagagttagattaatctctttcccgtttcaacaacaggaagaagccccacaaatcaagtatttcccttgttctataccttgtcattttgttgctactcccaccagccaaagagggaggaaagtttcttggtataattaaaatgttataggctgggtcgggggggctcatgcctgtcatcccagcactttgggaggctaagacgggaggatcgcttgaggctaggagttcaagaccaggctgggcaacatagtgagacccatctctacaaaaaaaaaaagatagccaggcatgatggcatccatctgtagtcccagctacttgggaggctgaggcaggaggatcacttgagcccgagggtttcaggctgcaggaagctatgatcatgccactacactccagcctgggcaatagagcaagactgtctctctaaaaaccaaaaattgttatagaatatagagttgaataacttttctggaatgagaaagctctcattttagatatccattcattcattcattcaatagtgtgctggatgccargaatttaatggtgargaaaatagacatgatctctgccttctgargctcaaratcctccctctatttttaaaaatcaggtttattgaagtataattgatgtacagtaaaawttactgtttttagtggaaacttctgtgggttttggcaaatgtgtaaccaacacaattaagatcyagaacatcctgtctctcccctcccaattttcttgtgctcctttggagtcaacaactctcccccaaccccatggcctccatgactttttcaaaaaaaaaaaaaaaaaaaaaaaaaaaaaaaaaaaaaagggcggcc

SEQ ID NO: 1924 - DNA, 957 bp, Homo sapiens
cccacgcgtccggagactgagtggcttaaacaaaagacatttattttctcacagtcctggaggctggaagtccaagaccaaggtgttcgcagggttggtttcttctaaggcctctctccttggcttggagatggccctggttggtcttctgagtgcaggtgtccctggtgtctctttgtgtgtccagattttctcttataaggacactggtgagattggatgaggggccccctgacggcctcatcttaatgtcatcacctctcttatctccatatccattcacatacgggccattgcgagctaccggggattaggggttcaacacataaattgggggtgggggggtgcagctcagcccataaacatgccccctctggctcgctctcccagggcatccatcgtagcacttagaaaaatgatcacttcttttttggctttgtggtggcgtgtgtgtgtgtgtatttgtatatacacacatatatatataaatacacagacacacatatatacaaacacacgcattcattttcgtccacagttcctggctcataactcccacagcccttgttacactcttttgttacaacattgggtgtgtcaggcctcaggagacaatcactctaacctcctgcccttccttttacctgcccaagacaggactctaatcttccctacctttctgatggtgggtcataaaactcattccagagacggtcccaccccatatcctgctagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtaaaaaaaaaaaaaaaa

SEQ ID NO: 1925 - DNA, 1034 bp, Homo sapiens
cccacgcgtccgttttatttaatttatacttaagtttgaatagccacacatggctagtggctatcatactggtcaacatgggctatctaattctgatgtacagtctctgcatcatcattccattttctaaagtgggtttctcccacagcagttgttaaaacaaggatttggatacaaagagattatttaagaggtgatcctagacagcaggagagggattgaggaggtgagatggagaaggtgaatactagtaaaagactacattgatatgctgtaggcacttgaggtttctgtttgtttgtttgtttgtttttttggaaaccttcgagagacttatggaaaacactgtataattgtttcattgaggagcacggaactgatcatgtttattcaccaactctcatgcctttttggttgaaggatgctcctaggggcattcacacctgctctgaactccttcttcatctccagcctgcctcccttatgggccatttcatgccactgtacctagataaagccttagggccaagagattcaggtgcttgaggctgggtctatccttctgagctgcaaataacttccagggtggatcaagggaatgtggggtcaggatagattatattgcctctcatttacaaccaaccatattagctcatattagtgttttatctggaataggaggagaagcatttgagactgttagaaaaaaggttctgctatttaaaaaaaaagttttgaaactgtagctctaaactacattcctacctgttttcctgaccacctcaattactaacttgtatcgtgttccatattatttctagcacagcatggattctctaacattcttgcagtctgggccctgcaaggtagctgtaaaaatgctgccctgggactttctcagtggagacataagaagactcaagcattccagaaagtgtttgtttggttggcttttattgatgtatataaaaagattagagacagcaagagaagaaaatcagagagaacctatacttggttaaaaaaaaaaaaaa

SEQ ID NO: 1926 - DNA, 1150 bp, Homo sapiens
ccgggtcgacccacgcgtccggttttggtacaagttcacagagaatcaacgttcatggtcggtgtgatgagagactgagatgtgaattgctcagtagagagttggcggtggcgtatcccagagtgtacttagaaacatgaaaacttctttgaaagggagctgatcacttttggaaaagatttacagttcttaggaatgcaaatatttgtttcttttccttttcatctaaaacatttaccagataaagttgagtccagagacaactaactaataagagaataattttaatatgtttttccattttggtgtcaacattgcatggattttttttcttgttccaagactggctttttccagtggaaacttagcagttaaaattaatttgttccaaatgaaatattgcatctgaaattaggctggaattgcagtagacgttcctggttcttgcaaaccagaggacattcttgaagctgtgtggtcccaggctctcccctctctggtttcctgtgttccctccctgcagcctcagactcgccctccagggctccactgtgcttttccaaactctcatcctttcctcccaggcgtcctgtgcagcacgccactgcctctcacttctcacatccacagctcctgcttggtcagtgttcctagttgagtgtcagaaattgaacaacccaattagctggtatttcatttgtaccaacctatgaatggaggagtagccttaattcccttgggggcttccacttctaagagaactgttttccgtccaggtaggcagacctgtcatggctgaagcttcatcacctggcctggtcatagcccccaggccctgtaggcaggacaggggcttggcagattggcatccttcccacaaaagcatgaaagtaggatgtctgtatgtagcgacaacaaatacaagaataaggagagtttaacaacattctcaaagttggtggaaaagaaaaagaatcaatgaaaacatcaccctaaaccagctagtgctttctgtttacagggatcagaccccttcccacttaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1927 - DNA, 1761 bp, Homo sapiens
ccacgcgtccgaagagaccttgggtaataagcttgccactgagtggctgctttatgtcctcaagggattgtaccatatcaagcactcagcattggtgtctgttgctaatggtcaggcattcagtagtggtggtagctagatcagccttggagagagagagcccatcatttcaggccatcacgactaatccattcatttatgggccctttgtaaggattgagatggctgaggacaggggctgacaggcattcattagaccagtcatcctgtccatatgcttattcagtgcttcttctgccacacgtgctctctggtgggctctagtgtgagacacaaagatcaacacattatgtgcccattcttatagctccagccacatgcctcttcctcagacatgcttggtttcaatcctctagtgttgttcccttgaggcccttgaccaagcaaccaagccattctccaccacctagaagtctgtgtatattcttacttttggccgcttctctccagacacaaagcagatgaccactggacttgaattggcacccagagttattttgggtgtgtctttagtgcagcaccagtccatctttttagctcacgccagcatatcatgctagcctaatccttataaagcccttttcctgctccttttctattctgtcaactgtctgtggagaaatccccaaggggccataggtattatgtctggaattggttctctccgaggggttcttggtctcgctgacttcaagaatgaagccatggaccctcgcagtgagtgttgcagttcttaaagatggtgtgtccggagtttgtgttttcagatgttcagatgtgtctggaggagtttcttccttctggtgggctcgtggtctcgctgacttcaggagtgaagccacagaccttcacagtgagcattacagctcttaaaggtggtgcgtccagagttgtttgttcctcccggtgggtttgtggtctcactggcttcaggagtgaagctgcagacctttgcagtgagtgttacagctcataaaggtagtgtggacccaaagagtgagcagcagcaagatttattgtgaagagtgatagaaaaaagcttccacagcgtggaaggggacctgagaaggttgccgccactggctcgggtggccagcttttattcccttatttggccccgccctcatcctcgtgattggtccattttacagggtgctgattgccccattttacagagtgctgattggtccgtttttacagagtgctgattggtgcgtttacaaacctttagttagacacagagtgctaattggtgcatttttacagagtgctgattggtgcatttacaaacctttggctagacacagagcgcttattggtgcatttacaatcctttagctaggcagaaaagttctccaagtccccacccaacccagaagtccagctggcttcacttctcaatcctccttctaaacaggacaccacaagtgttgttgggaattggccgatgaccgctctagctatttcctgctggataggggcaaagaaggggccctgcagttgtagtgtcctccagaggggaactctttaggccagtgaaagggccagcaggttggtctggggtcctcagtagaagttgttagttgagctcatttggggttccatttgtaagaccatctgtagcttgatggcctcaattctagaggaaacaaatttgacaaggagattaaaaatacagggtccaaaggcaaaaaaaaaaaa

SEQ ID NO: 1928 - DNA, 616 bp, Homo sapiens
  misc_feature (610)..(610): n equals a,t,g, or c
ccacgcgtccgaaaattagttaggcgtggtggcacacacctgtaatcccagctacttcggaggctgaggcacaagaatcgcttgagcccgggaggtgcaggttgcagtgagccaagatcacaccactgcactccagcctgggcagcagagtgagaccgtgtcccaaaaaagagaaggagaaacagagatcatgtggaaaaagttattttttatttatttacttagttttcagtttggtttgagactcgtgttttaaaccagagggcatggttactgagggataacatcaatagaactcctataattgaggggataattatcaaggtattagatgattcactggctattacaaagaacacagaaattatgaaacctggttctgtaacttatagtttttcatattatttttataccatggataactcttctatgtgtattcataggtgtaagattactggcagtgtcatatgaaacaacatattacattttttaagcctggaaagcatctagtatggctgtgcacgtagtgatgacattgactttttttacttaaagaagagctaccacttcaaataagaaaaaaaaaaaaaaaaaaaaaaaaaaaaaaaanaaaaaa

SEQ ID NO: 1929 - DNA, 573 bp, Homo sapiens
gctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccagtgttggaggtggggtctgctggagggtggttggatttctcatgaatagtttcatactgtcctcttggtgctgttcttgtgatagtgagttctcatgagatttggttatttaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaaaaaaaaaaaaaaagggcggccgc

SEQ ID NO: 1930 - DNA, 1384 bp, Homo sapiens
cccacgcgtccggaggaattgctatttaagtggaaagtgcttgaacagccaaatgagcacctgtcatgtttattttcactttgaaaagtagaaacatgacagtatagtttccactgcctatccaatatgaacttctggcattcttgttatcttctcaggaactgcactgtttgcttcttgtgttcaattttttttttttttccagggatgaggatgtatctctcctcctgaaactttcactctaaaatatgcccccaaatactgacattttcaagcttgtgcttttttacttgatatctgattttttttaaatttttatttaatagggagaaggtcatgacttatggaatttactctaaggatagggatctgagcaggttcctgagtacttgaaaggctttatttacctcttacacttttttgttacatccaggtttttgctcatttctctatcatttgtgtcttgaactttacctgaaatgcatgtcttgagtgcctactaaggtccaggcattgtgctggcagatttgatatatttttgtttattccttattacaggactattacatagtagactctcattctgacactcactttttttttccagaaaaaaaaattaatggagattgattgctaatgggtacagggctgcttttaaggctatgaaaatgctctaaaattagtttgtggtgatggttgcacatctctgaacgtactaaaatacattgaattatatactttcttttttcttcgttttgcagcttttgctcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacggatctcttgaggtcaggagtttgagaccagcctggccaacatggtgataccccacctctactaaaaaaaaaaaaaaaaaaaaaaaaattagccaggtgtggtggcgtgcacctgtaatcccagctactcgggaggctgaggcatgataatcacttgaacctgggaggcagaggttgcagcgagtcaagattgcaccactgcactccagcctgggcaacagagtgagactccgtctcaaaaaaaaaaaaaaaaaaaaaaaaaaaaaaaaaaaaaaaaaaaaaaaaaaaaaaaaaaaaaaaaaaaaaaaaa

SEQ ID NO: 1931 - DNA, 706 bp, Homo sapiens
gcccacgcgtccgtgcagagagactgggtgctccgagctccactcaggtgaaagaatttgcggcaattgttgacgtgaaagaagaatctcattacatcttggatccaaagcaagcactgatgaagctcaccctaggtactgcaggcagtttatttccccaagcattgtacattttgcttgacttcatatgggtaaattttattgatggctctcattacatttagttgtggggtgatgtcaccttcgtagctcattttaagtctttagaccaccatcagtcataattttcaaagaagctaattttgtctattaaatggaacagaaacttcctcactctgaattttggataagtttgtcatttagcccatggtgggggtaagagtcccactttctaaattggtgatttctgtcacatgtctaaggtagaaccagctgcaggcagtggggacttggggactagaacaggcagggaggtggagagctattctggtgggatgtcctaggggctgatgaaagtgagccttgacagcagctttgttctaaaggagcttaaagagaaagcagtggccgggcgcagtggctcacgcctgtaatcccagcactttgggaggccgaggcgggtggatcacgaggtcaggagatcgagactatcctggctaatgtggtgaaaccccgtctctactaaaaatacaaaaaaaaaaaaaaa

SEQ ID NO: 1932 - DNA, 419 bp, Homo sapiens
ccacgcgtccggaagaggaggtttgtgttgccttcagatgactgttgatttaattgacaggcagcttttcttcattgtgtgctttttgcttttgctcacaaaagtgcattcactattctatagtatgttgaaacttttaaatggaaacggcttttcattaacaaaggaagcattttcttccccccttccatgccttagctttctccgctaagtcttggcttcttcagcagctgtacctccaccagaaatgacaaaaggtgcaattgtgctaggagatggcgatgaagatatgccagtggagttttgtgtgtgggctgctggggactgttttccttctgtgtttggttttgttttatttttgttattccagaaagttgagagcacatctaaaaaccaaaaaaaaaaaaaaaaaaaaaaaa

SEQ ID NO: 1933 - DNA, 1025 bp, Homo sapiens
gccaagcttcaaacatagatctcctgactccattcatatgaccctataaactgtctcaaaacaaaaagataaattaatataaatatttattgaatatgtctttgtagagaaagcataataagcataaagggcaatgcgttaacctttatcacaagcaaccctattggaatgtgtcaacttatcagaatgaatcaggccagaatatcaagtataaatgaagcctgtagttaactgaaagttgcatatcaatcaggcactccagtttctctcctcaaactctgaatattcaatgaataagataaagaaatggctaatttgattttacctttcatttttttgacctaattctaaggtgactactcactcctcaagatttaactaatgttgctttatttttatccctctggggagacagaagagatgattgggaaacacatgtttgaagtttgtaagttctgctgctttcaaccccacagatgtctcttactgcccacttggsscctkgtgattaagcaactagatttggagccagtcaggcttttgtttagacattttaactttttcttgctttccttgcaaactcctcagccttcagactggttggaaagtaaatgtacaatcttacataaattttcaggtaatagcatttcagctttttccccargattttttgcttgggaggagacagattagactggattcggagtcttgattttgcaaaggtaacaaaagacatgtttttttataagacttttcatcataagtttattttattcaacagaagcaaaatctaatataatggaaaaaataaagatctgtgataaatctgatctgtgtkgataaacacaattagaaagatttaaagattaagtattgaaacaaactaccaaaatattttaatactgatttgtaaaaatttcagtacatttttcttctttgcttaattctactgggtcctgtttttcatcaaaacattctatcatgttagtatacaatagccaaaaaaaaaaaaaaagggcggccgc

SEQ ID NO: 1934 - DNA, 1390 bp, Homo sapiens
  misc_feature (1301)..(1301): n equals a,t,g, or c
  misc_feature (1308)..(1308): n equals a,t,g, or c
  misc_feature (1327)..(1327): n equals a,t,g, or c
  misc_feature (1347)..(1347): n equals a,t,g, or c
  misc_feature (1355)..(1355): n equals a,t,g, or c
gttgaggtgagtcagtttctgatgcagttgggctccaccgcatgctaggttccagcccacttatgctcatttgggctaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggraaataagtcatcatctgcttgtcctcaggtaataaattatgccagaagatgaatacggtgatcaaagacagacattttactgcctttggtttccyaaaargawtacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgstgctagccctamcctgcagggaccctcagactcgccaacctcagattcagtttctcagtccagcacaggaactctgagttccacctcctttctcagaactctaggtcgtcattggcatcagacttacggactatcagtctgccagtgctgggcagtagctgttacangcctcanggtatctgcggttccaatnacagactaccacacgtggantgggtggnacataccgattcagcatgaaggtagagtagactaa

SEQ ID NO: 1935 - DNA, 783 bp, Homo sapiens
  misc_feature (14)..(14): n equals a,t,g, or c
gactcactataggnaaactggtacgctgcaggtaccggtccggaattcccgggtcgaaccaccgtccgcggacgcgtgggttttaagttgtcgtcttgcctctgtgctcttgaagttttgagccctttgcatttggcagtgtccaggcattcaggcctggagcccgtgtagtgccagtgcctccctccacgctcttggcctggttgacctcacctaaaccctccaaaaagcagatggtcagactctcttcccttcaaactcttctctgccctgactcacacctgggccatttcatccagtgagactgagggaggagcgagggagtccatgtttcccctccatgacgccgggacaggaagctagactcagtctcttccatatggccaggaaggggagtacctgactgcccatcttggttttgggagagagaaaaaccagtgctcagtctgggaaatgaggttttgggggattgtgataaaatagaggacaggactctgcaggtcaaggacagaggtgcatcctgagggcgcactgcagtcagggccaagtggctcactctttgcagctttagcagcaccttggatatagttgctgctccgtaaacgtgttgattgacagaggtgcaggtaaaaacctcagaacagttgggcttaaggatgctacaaaaaaagctctgggatgggatttaattttttttttttttaactgttgttatcagcctggccaacacggtgaaatcccatctctactaaaaatacaaaaaaaaaaaaaaagggcggccgc

SEQ ID NO: 1936 - DNA, 909 bp, Homo sapiens
  misc_feature (909)..(909): n equals a,t,g, or c
ggctggggtttgccattttgtgtcttttttagtgttcttccaaattaaattttcaagatcaaatatgggactcattgtcctgtttatggagctttttttcttttggttgactattcttttgtttcctacagtcttcaacaactgttagtgcttacaatggatacatcatgcatcttaattgataggatggatatgataataccttttttggtccaaggtcccgctcattaaaaaaaatagtttataaagctgaaaagtttttatttctattttttgtaaaatgattttcatgataggattttatataaaggggaagggttttttgtatcatttttataacatttttgaaatgagtacttattctctttcatcatctattttagactcacagttttatgagtaatgcagtaaaggtcatgtggcacattagtaaaatatgttctgaacacagaaactattctccttatcacaaattaaattttatgttaagtttgaagagcactggcctggggtatactttgctgtgaaaagatcattttggtcacttaaattacaatagaaatatttgtgttaagaaaattaagtaaaaattaggctgggcacagtggctcgcacctgtaattccaggactttgggaggcctaggcaggtggatcacctgaggtcaggagttcgagaccggcccgaccaacacggtgaaaccctgtctgtactaaaaatacaaaaattatccaggcgtagtggcaggagcctgtaatcccagctccttgggaggctgaggcaggagaatcgcttgaacccgggaggcggaggttgcagtgagccgagactgtgccactgtaccccagcctgggtgacaagagtgaaactctgtctcaaaaaaaaaaaaaaaaaaaaaaagggcggccgn

SEQ ID NO: 1937 - DNA, 766 bp, Homo sapiens
  misc_feature (758)..(762): n equals a,t,g, or c
ccacgcgtccggtctcagcaacaagagcaaaactccatctcaaaaaaaaaagaaaaaagatggcttgccctggcattggcgtttgtccttcttgtacacacaaaagcatcatgctttgtacactgttcgtttttgtttcgttcactgtcttcacggtaaagatgaactaagagccactgagaaggctgtttatgggaaccagaaggttgtttgcttcccttaagttcgctcttcctggcacctggtgcccttgcagcccatggggaatgtgatggtcacgttttctcgtctctcctgcctcatcccatcagccagttcactgctgtgcctgaactcctgtacagggtgtctggtgcatgtccacataacaaaaagatggtactgatcattgagtttatctccaaaaatttttttcaatttgattgtagaaaatacatttttaggcggggcatgatggctcatacctgtaatcccggcatttggggggccgaggcgggcggatcacctgaggtcaggagttccttacagcctggccggcgtggtgaagccccgtctctgctaaagatacagagactagccaagcgtggtggcatacgcctgtaattccagctactcgggaggctgaggcaggagaatcgcttgggcctgggaggcggaggttgcagtgagcagagattgcatcattgcactgcagcctgggcgataagagtgaaactccgtctctaaaaaaaaaaaaaaaaaaaaaaaaaaaaaaaaannnnnaaaa

SEQ ID NO: 1938 - DNA, 712 bp, Homo sapiens
ccacgcgtccgggcctccaccacaagaaattggctccaaacctattcccattacatcatcacccactaatgtcattacaccagaatgaaatctgctttgaggcttgtattgttgttttccttccatttctttcccctcatcatttcctttagaaggaaaagggaaggaaaaaaaaagaaaaaaatcagagacctgtaaacatttaagagtgaattggacatccccacaggctaaacctagagttgtcagctttcattccattctgctgtgatagagtgttctgcccagtatgtatccacatggagcctggaaagtaacaagtctggtcatgtgacaactggctttggtgctttgctttcagcccctcagaattagttcctaatggctcacatagctccctgccagcatcccgtcactggcacgttaaaccttttcaaataattcctcagaatagagattcttaggagagcactaaatttctccattctttgtgtttaattaaactgttcttgcattttaatatttgccagataagcgcttaagacattacgatacaggttgagtatccttaatctgaaaatctgaaatccgaaactttttgaccctgacatgacgctcaaaggaaatgctcattttcgattttggatttcagatttgggatgctcaaccagtaagtataatggcaaacttattccaaaaaaaaaaaaaaaaa

SEQ ID NO: 1939 - DNA, 680 bp, Homo sapiens
cctactttgccagtacgatctgttcctctctctctctcgctccaaaagactaatctgcacactctgttacagcacttgtctaattgtgctgtagcgtttatttacatgtttgtttctcctctagccagtgagcacctctcaagcagaattatcttccttgtttctctggcaccctaaatatttgttgaattaatagtccttctcttcttttgtaattttgctttctgtaatagaagcttaattttaagtatagttatatcagtaatcaaaatgaatcacacactgagaaatcaatgtggatgccctttaagggttctgttattttttttattgccattgagtaaaataagatactctgtgataaagtatattagcattaaagtgttcaaatctgatctttattagtaggcctcaagtgaatccttgctgacatttaaggtttatgacatttccttcacgttcgttcttgactggaaggcataaatggctgacagtaaagagcaattaataattttccaagtaaaacattttcagggacatctgcctttattgctccccagatgagagtacagcctgtttcttatgtgttccaaagatgatttccctatcagctttttggtcagttaaccaaaaaaaaaaaaaaaaaaaaaagaaaagaaaaaaaaaaaaaaagggcggcc

SEQ ID NO: 1940 - DNA, 1004 bp, Homo sapiens
ccacgcgtccgcccacgcgtccgcagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtaactttttaaaggcccactttaaattccaccactctataaaaagcttctccaactattctacctttcaatggctctcagtttcctccataatactttggaccttttagctgatcctgactctcttgcactacagtgtaaaggttctgtatttatgggctgcatactggcatgatgcttctcagttatgtatgatatcatagtcgctttttcaggacaaaactgtgtcacagtgttacagcaaaatctataacacagtgtcggcatgtaaattcagctcagtgaatgcttattaaacattaacgtaatccttgttgctttctttattcaaccctacagtgaaattttctgggtgcttggagtaactaaaatatatttgcagatatttaatttcaacttttacacattaaacaagtagaaaaccatgtcttcaaaaacatattctttaaaagtgattgtttagggcaaaaaaaaaaaaaaaaaaaaaaaaaaaaaaa

SEQ ID NO: 1941 - DNA, 1305 bp, Homo sapiens
  misc_feature (329)..(329): n equals a,t,g, or c
gcggaacgstggtgtgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcctggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtntgtatttaaaaataattgtgctgtcaaaattctgtcaagttggcttttaccacattagttttttttaatgtggtttatatgaccctgragtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtggctcacgtaatcccagcactttgggaggccgaggcaggcagatcacttgaggtcaggagtgaggcaggcagatcacttgagatcaggagttcgagaccagyctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaagggcggccgctctagaggatccaagcttaccgtacgccgtgcatgcgacgtcatagctcttctata

SEQ ID NO: 1942 - DNA, 813 bp, Homo sapiens
gaagaaaacgtgaccgtaaatatctgtaggatataggaaccagagagtagatggaacatgactagtaagagacttaaatccaggggacctcaggaggtaatacaaaagaattttgtattacggaattgtttacctagaatttgaactcgggagagaatccctgtgtaggagtatatttctgcaaagaaagtgcttaaagaaatggttcttccttcaatctgtttctttgatttgtatcagattagggaaggggaagctatttgttggacttttcattttggtaaaatctgaatgagtattgagaatggctcttgagacagtagtgcactttatattgctttccttactggtttttatgtatgatttattaataggcaaaaatctcattatggtgagcttaatgacaaatcagtttgttttaaacacattttattaaaatacatttagtttaaaaagtaaatttccaaactaccagctgaatacaactgtccagattcttgcaaggaaaaccaaatgctagagaaggccaggcgcgatggctcactcctgtggtcctagtattttgggaggccgaggcgggtggatcagtttagctcaggagttcgagatcagcttaggcagcatggtgggaccctgtctctacagaaaatacaaaaattagccggaggggaggcatgtgcctgtagtcccagctactcgggaggctacagcagggggatcgcatgggcctgggaggcggaggttgtagttagccaagatgacaccattgcattccagcctgggtgacaggagtgaaatcctgtctcaaaaaaa

SEQ ID NO: 1943 - DNA, 1694 bp, Homo sapiens
ccacgcgtccgaagtaatttggaaaattttaacattcctagtgacttaagatttgattaatagccttgttggtagtattttatatattcctaaatactattgtaaaatactccctcaataaatcctgcatgcctttaaaagtccctctcaaaataatctgtttattcggcaggtaattgccaatgtgttttttggtgggaatctttcatcggttttccacattgttgtaacagtgatggtcatcactgtagccacgcttgtgtcattgctgattgatgcctcgggatagttctagaactcaatgtgagtacgtgcaaagatttaccccttcactctaaaattctctttaaaagataatgattacatttaacataagatgtattttccttaacaaaagtgtcacttttgaagtgggaatcaaaatatgtttgtaatagtaaatatttcaatgatgattctgtgcactttgtgggactatatagttttaaagtagtggttgtttagagacatatggggtcgtcacaactgggtaggcagtgctgttggcctctagtggataaggccagggatatacatcccacaatgtgcaggtctctcacacaaaaaattatctgatccaaaatgtcaattgtgctgaggttgagaaaccctggtttagagtactttgcatatctcatttactataacacataaatgttactaaaaatagctataaattaagtggatttggactttgctgaataataatattctagtgaaatttatgagaaatatgaaaggattcaagttatatccattcacttgctatgacaaaatttctttttctttaaatatttttctttctccagatctttcttttatagtctgcactgccatcaaccaaatagaagtcctcataatatcacagttgaattaatcccagctctgtttcaactatcatgtatttaagttctgctttcagtttatcggcattttcctaccagagcaagtataaattccgttgcttctaccttcttgtcttctgtgtaaaactatttcccatttacttcccaaaatttatgttcagctctagtcaatctaattttttggcctgtgaataagccatatcaattctttccattattctttgtcctatctgctttttatttccgataatgattatttttctttcatttctgtccaaattttacaaaaactttaagatccagtgcaacttctaattcctttattcacattcactgatcatatatttattgagtaattactatgtgccacacaatagaatataaggatgaatgcaataagaaaggacctgtgcattctcacaaataaacataaaagttcaactgcaatataggtgatgaagacagaggaggccaggaacggtggctcacgctgtgatctcagcatttttggaggccaaggtggatggattgcttgagcccaggagttggagaccagcctgggcaacgcggtgagaccccgcctctacaaaaaattagccgggtttggtggcatgtgcctgtggtcccggctacttgagaggctgaggtgagaggattgcttgagcccgggaggtagaggtttcagtgagctagatgcaccactgcactccacctgggcaacagagtgagacccggtctcaaaaaaaaaaaaaaaaaaaaaaaaaaaaaaaaaaaaaaaaaaaaaaaaaa

SEQ ID NO: 1944 - DNA, 865 bp, Homo sapiens
ggcacgaggtgaggtgtgccttttaccttctgccatgattgtgaagcctccccaccacatggaacggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgttaaacatttacctgaatgttgtctgaggactgaactgtggactttactattcataatgataaaataataaaatgcgaattactatttataatgtgcctcactcatgagaaaaaaaaaaaaaaa

SEQ ID NO: 1945 - DNA, 337 bp, Homo sapiens
ggcacgagccagctttaaaaatataaatataattcttttcattttagatggaaatcatttatgtcacattactcataaatgtcgtggtggtgcatgcctgtaattcttggagatctctcaggcagatgtcacccaagtattctacataatatgatttccatctaaaatgaaaagaattatatttatatttttaaagctggtatactgcttttgcaagttattttttttttaaagcaaaggtattttaaaggacaagtaacaagggacagagtaactattaaattaattatcttcttttaaagtgcaaaaaaaaaaaaaaaaaaaaaaaaaaaaaaaa

SEQ ID NO: 1946 - DNA, 1777 bp, Homo sapiens
ggcacgagactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccaatgacatgccaaagagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtaccagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagactagaagactgttctgtgttaactacacttctcaaaggacctctccaccagaggtagcttcaaactctccagcatgtaataattctatcacaaatctctcctgaggcttaccaacatctaaatgactttgcatttggggagattcaatgatttggtttgtaaagcaagggtctgctgcttggttttcccaggaaaaatgaacaaagatggagagagtccagaaacagaactacatatatctggaaggagccttctcctgaaaattttgcaggacagttccacttacctaaatcagatgaaacacacacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcaaaaaaaaaaaaaaaaaaaaa

SEQ ID NO: 1947 - DNA, 1940 bp, Homo sapiens
catccgcggcgcgggagacgagccggccgtcccgggccggggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctgggcacggaacagtatttgttggccaaacaactagcaaaacccaaagagaaaattcccatcattgttggagattatggcccaatgtgggtttatcctacctctacttttgacttgtgtggtagcagatcccagaaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaa

SEQ ID NO: 1948 - DNA, 1469 bp, Homo sapiens
ggcacgaggaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtatttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtggttgaggagtgggcccagggcaccttcaaactcaaccccaatgatgaggacatccacacagccaacaagtgccacctgaaggtggtcacggacctcaggttgtggatgtggcagacctgcttcacgctctcgggcctcctctgggagctcatcaggactatgggggattgggcagaggtcaggttcctgctccagcgtggctcctggactggcgccagatgctggccctgggggtttcaatccaagcataattcagtgaagcatgtgtttggcatgggacccagctcactgttttaggtcagcccaagactaccccgtcggtcattctgttcctgccgtcctgtgagagccccaagccaacaaggcccactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccacccacaggggcctggagctgcaggatcccaggggaggggtctctctctgcatcccaagccattcagcccttctcgctgtacccagtaaaccctcaataaatatctttgtcagccagaaaaaaaaaaaaaaaaaaaaaaa

SEQ ID NO: 1949 - DNA, 1013 bp, Homo sapiens
  misc_feature (10)..(10): n equals a,t,g, or c
  misc_feature (13)..(13): n equals a,t,g, or c
  misc_feature (41)..(41): n equals a,t,g, or c
  misc_feature (150)..(150): n equals a,t,g, or c
gaagagcatntcntccgtggcagaaacctgaaaatgccccnggggagacacatgcacaagacagtgagtgatgcagccatttcccacgtatctcacaatgtacttctctggtcttactaggactaaatgagtatctcagtccataatcanagggagaagaaccaccacagaccacatacctggggtcttgaaaataattccatgcatgtgggactttcagaagctgtcccatgtctgtccagaagggccccacaatataatggggggactttgtatgtggctaagcatggagcaggggcaggatkttcagtcccactcactcccttggccaagtgcccttgtgcagtgaacaaastgcacaaccatgctgggcagaagcattttatatcagtccccttcggacttagtctcacaggcatcatttgatgggggatgggagatgaagtggttcttcgttttctagatactttattctataagttggatcacctcaagcaaatgcgtgagtgcagctagccaagttctctatctcacagtcttcatatggctggctgtcgctgatgagtgagtgagctacgaaatcagcttaaagcacaacatgttattttgaatttgaataaaataggraaaggcagagtgcattgtgtgaccatggggtaagtaagacactctccctttctccttctcagttttcctgtcataaaaggacmaactactatctaaggtctccgtagttaaaatctttttgttgttttttttttatttgagacagtttggctcattccccaggctggagtgcaatggtgctatcttggctccctgcaacctgcgcctcctgggctcgggcagttctcctgcctcagcctcccagctactcgggaggctgaggcgggagaatcgcttgaacctgggaggtggaggttgccgtgagccgagatcgtgtcactgcactccagcctggcaacaagagggaaactccgtctcaaaagaaaaaaaaaaaaaaaaaactcgag

SEQ ID NO: 1950 - DNA, 1265 bp, Homo sapiens
gggcgtgcaggaattcggcacgagctgagaccctcaccccatcacaaaacaagtcagacagttatggggcgggcacagagggtcaggttctgtcaatggcggatggggggtgccctgggttgggcatccaggggtcctgggtgaagttgatctgcccggacctctgtgacctctttgcccaccatccccagcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagctcagggacagatctgatgatcccagaaggctctggaggacaatctaggacgtccagaggggggtgagatttcaggccacacactgtggaaggtaatcatgtctgatcacaaattttgggtctccaccttacttccaatctatgttgtgaatgcccagttgagacccacggaaaagagctcatgggtgagtgtgaagtgcttctctgtcttaagttcccagagatccttgcctcttggaggccagcaaacactaactcttgaggaattcatgacaatatcatctgattcctccttcccagcttgtatggcagtctcccaccctcatgtgttcaatctgatgatcccaggargttctggaacaaaatctacagcctatgctttctggactatctgtcgatcattcctgaagagagggatcaatgttgaggtattcatttcacmtgatgaaaatgacaatatcaaatgtcagaggtagtagggctcacgtagaaatccaatacatccatggtaggactgcaaattacttgaatcaatttggggaaaatatcagaagtacccagtgaaaaagaagaaacatggccgggcgcggtggctcatgcctgtaatcccagcactttgggaggctgaggcgggcggacacgagttcaggaattcgagtccagcttggccaacatagtgaaaccccgtctctactaaaaatacaaaacattagctgggcgtggtggcaggtgcctgtaatttcagctactcgggaggctgaggcaggagaattgcttgaacctgggagacggaagcaagttggcgccagttggtgcagtgagccaaggtggcgccattgcactccggcccaggtgacagtacgagacttcatctaaaaaaaaaaaaaaaaaaaactcga

SEQ ID NO: 1951 - DNA, 2122 bp, Homo sapiens
  misc_feature (845)..(845): n equals a,t,g, or c
  misc_feature (848)..(848): n equals a,t,g, or c
  misc_feature (1100)..(1100): n equals a,t,g, or c
  misc_feature (1745)..(1745): n equals a,t,g, or c
ggtgcgtgcgtgcctgatacacatggagccgggctgcttcacacatctggtgaggtcgttagaaggtcagataaagaagagggcggacttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctwwaccttwtatcttcgtgttggcactgttgccatccccgccctctcccgacatccccgcccttgaccagcatcyctggccttgcccagcattgtctatgtattggcactcttgccatccccgccctttcccagcagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttnttnttttttttttttttgaratgragtcagagtctcaccytgttgcccaaggtgragtgtascggcttgatctcagctcactgcaacctccccytcccaagttcaagcgattctctgcytcagcctcccgaatagctgggattacaggcatccgctgtcatgcctggctaatttttgkatttttagtagagacgggggtttcaccatcttgaccaaactggkcttgaactcttgacctcgtgatccagctgcctnggcctctcaragtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggnrccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatgaagcttaaaaaaaaaaaaaaaaaaaaaaaaaaaaaaaaaaaaaaaaaaaaaaaaaaaaaaaaaaaagggcggcc

SEQ ID NO: 1952 - DNA, 643 bp, Homo sapiens
ggcccttttggttagcatcattgactaatactgacccaaacagctctaattcttaagccccctccaaaaaaaaaagcatacatatttttatttgaaatgaaattattgatagtgattttttttcatttcttgtaaatatttgcaccaggaagccaaaggggggaaaaatcatgctatctgtactagaaaatttaacctgtattactgttatctaatatgctttagtggtcttcagactattcactaattaagcatgttctttaataccaccaaataatattcattgttatgcacaacaactgcaaagagattgagtcccaagatctacaaaggattgtgagagttggtggttgagatttgtcacaatcagaatgggactcaactggtacccacagtcttacatttactcaaatttaatccagttcaaaattttactactgcatgcttttattcaaatgaaccacaaatgcatgatttaaagactgctgggattacaggtgtgagccaccgcacctgaccttaaaccagcccttttggttagcatcattgactaatactgacccaaacagctctaattctcagccctactccaaaaaaaaaaaaaaaaaaaaaaaaaaaaaaaaaaaaaaaaaaaaaactcgag

SEQ ID NO: 1953 - DNA, 608 bp, Homo sapiens
agaactagtggatcccccgggctgcaggaattcggcacgagctcaaactttaaatgggtaagatgcccggctaattttttgtgtttttagtagagacagggtttcaccgtgttagccaggatggtctcaatctcctgaccttgtgatccacccgcctcgacctcccaaagtgctgggatcacaggcgtgagccaccacgcgcggccagggttctttttgtatgcttttctctctgctgcatttgggattttgtgcatatgagtctaacttaatacttttccagatggctatccctatccctgggcagttggttaaaaagtcgtttttcccctcactgatttgggtcgcagggactgggcctgttcctgtgtcttctggtgcttatcccaccctgttttcattacagtaagtttcccctgagctcataaagctggtcctctttcactttcttttcatggtttttttggctgttacttgcttgttaatttttccatatgagcatggtagttccagaactgtggtttttactgggatcgtattaaatttacaaattgtatcggaaaaaaaaaaaaaaaaaaaaaaaaaaaaaaaaaaaaaaaaaactcgag

SEQ ID NO: 1954 - DNA, 1277 bp, Homo sapiens
ggcacgagggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaaggcttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaaaaaaaaaaaaaaaaaaaa

SEQ ID NO: 1955 - DNA, 1982 bp, Homo sapiens
  misc_feature (666)..(666): n equals a,t,g, or c
ggattgtaacacatgacaaagtttgagaactactgacaggaagagtcctgctgctgagttctaggcccagttctgtcactggctcactaaatgacttcaggcatgtccctctcctattttgaacttcagttttctcttctgtgaaatgaaagccttggactaggcagcgtctaaaggctctgtcactccgtaattgtgtgactttggtaactttgtttgacttctccttgcttaagttttctcatatgggtatggtaaggaaaatacctacctcacaggattttctaacaattttgtgattattaagtatgatgactgatgactaatatatgacagccagctcttacacagtgctttctatatcctggactgttgtaagtgcttttaatccccgcaacaatcccatctccattttacaaatgaaaaatagaggtcacacggctaatacgtgtcagagtttggattaaaacccagaaaaatctgtccccagagacaatgattttaactagcatgcccttttgctcaataaatgttaattccctcaccctttccacacacacacagtctagctgaccattcatagacaataatcccactttcacagtccatccaacaagatcttaaaaaaaccatgaaaatctctaggtttcttttgcaaatagtttncaagcatttaaaaaaaaaaggtggggggcggggagggagtggccaaaatggctgactaaaagcagctaggatgagtggttctcatggaggggaaggaaaggggcgagtaaatacagcgccttcaactgaaacatccaggtacccacattgggtctaatcaaggaaacaactcgatccacagagaatgaagaaaagcaaggcaggatgacagcccacccaggagcaacatggagacagaggaacctcctccacccagggaagtcgtaagtgaatgtgcgatcctgggaaaccacgctcctcccatggatccttgcaacccttgggtcaggagatcccctggtgaacccactccaccagggccttcagtctgacacacagagatacatggagtctcagcagagtagccgcttgagcacgtgcagagacccagcagctttacatactccggccctgggtttcccagcaaaagtaactgcaactcctgcaaagcgggagattagacccctgtacatacccctaggaaagaggctgaatccagggggccaagcggcacgatctgcgggccccacttccactgcacctcacaggataagacccactggtttggaattccagccagccaccagcagcagtgttgcacctacctgggacggaggtcccagggggaagggcaggctgctctctgggacagagctcccagaagtggtaccccagaacagcacagcacagctgctcttcagaagcatggccagactgcttctttaagcaagtgcccaatctgttcctcctcactgggtgggacttttcaaccaaggcctccagcaacccctactggtgttctctggctgacagagatttgaattctccctgggacagagttcccggagggagggaggggccaccatctttgctgtttgggcgacttagctgttccggcctccaggctttggagagcccacaccaaccaggggtggaagcagtgccccagcacagcacagctgatctgtgaaagcatggacagactgcttctttaagcagttccctgatcccgttcctcctgactgggtgagacctcccaaccagggtctccagccttgtcctgcaggcgcatttgggctggcaacaggtctgtacctcgctgggccggagctcccagaggaagaggcaggatgacatctttgctgtttcacagccttcactggtgatagctccaggtactggaaaatccaaggagactaggaactggagaagaagcccagcaaagtacagcagccctacagaaacatggccagactgttaaaaaaaaaaaaaaaaaa

SEQ ID NO: 1956 - DNA, 1600 bp, Homo sapiens
  misc_feature (95)..(95): n equals a,t,g, or c
ctccattaagaattcattactaatagcagaagattttaaactatctctgttggtagatgaagtgattcttgcatagatagagagagccatttgtnaccacagctggctaagtccccctccttccttcacttagtctgtattagtttgctagagctgccataacaaaatatcagagtctgagtagctttaacaacaggaatccactttctcacacttctggaggttggaaacccaagatcaaggtgctggcagggtgggtttcacagagagctttcaaggaaggatctgttctgggcctttctttttgacatgtagatggctgcccttttattgcctcttcatctgtgtctgtgtgctcctgatgtctctctctgtgtgtccaaacatcatcttataaggacaccagtaggaacggattaggtcctaccctaatggtcacattttttacttgattttctctttaaaggctttatatccaaatacagtcatggtctgaggtacaaggtgttagggcttcaaacatacgaatttgtgggagtcaattcagctcataacatagtccatgagcttgtactaattggaagtgaggattaggtttttagttgtttccttccttccaattactctagatctttctccacttccagttgaccaatcccttcatgctgccagccccacatttgacttgactgcctttacctacactctccagtctttgttattctttccttcctcacatccaaatgtaactctgccacaacccactagacctctattaggaatcatttgaaaactaaaaagtaaaacatctatttgacccccttgacccatgctttctggctgcatattaaaaataatagcaaaaatcatgattacttttgcaccaacctaatattaaaatcatctggggtgttttataaaaatacctatgtctgggccctaataccagatcttctggtttggttggtggagtgaggcccgtgttcctgatgatctgaccactctcatacatttctgtctgtgcttctcttagcctaaaatgctctgtgctttttttccaactcatgaattcttatctattcgaatttataggtggactgtcacttcctcaagaaagcctccatcagttaccccagggtagtgtattagggtcagtctagcagagcagtaggtaacgtgaactaaaggcatagagacctgagtgtgaatgtcttactttgatctttcttaaccaggggactttgaacattttcttaagcctgttgagcctcattgkggtaatcatgaaaagggaaagtcttaaagcatgtcacatagggttgatgtgagaattaagaaaattaccatatgtatgcttcctagctggtagtacatgtccatttaataatctctccttctggtggcgggcacctgtaatcccagctacttgggaggctgaggcaggagaatggcgtgaacccgggaggcggagcttgcagtgagccgagacagcgccactgcactccagcctgggcgacagcgagactccgtctcaaaaaaaaaaaaaaaaaaaaaaaaaaaggaattcgatatcaagcttatcgataccgtcgacctcgag

SEQ ID NO: 1957 - DNA, 1818 bp, Homo sapiens
  misc_feature (1007)..(1007): n equals a,t,g, or c
cccccgggctgcaggaattccccacacctagcctacattctttttaaattttttgtttttagttgacctataatacttgtagaaagacaaagaatacagtgtgatgtttcagtgcatatatgcattgtataaggatcaaatgagggtaattatatccatcactaagcatttatcatttatttgttgtggtaatattcaaaatcttctcttctagctatcttgaaatgtctatcacattgttatttgctgtactcaccttactgtgtaatggaacaccagaacttattcttcctgtctgattgtaacttaatacccattgaaacaacttctcatggtcccccccttcccccatactccccagccataggtaaccactgttctattctctgcttctgtgaaatcaacttttaaaattcaagggtgaaattacacagtgtttgcctttctgtgccttgctatttcacttaacataatggcctttaggttcatccatattaccacaaacgacggaagaatattctgtttataatgttccattttgtgtgtgtgtatacacagacacacggcattttctttgtccattcatctgtagatgggtgtttaggttgattcatgtcttgactattgtgaatggcactgcagtaaacatgggagtgcaattatctcttcaatatactgatctcatttcccttttgatttacacccaaaagcatagggaacaaaagcaaaaacagacaaatgggattacatcaaactacaaagcttctgcacagcaaaggaaacaaacaatatagatcgaagagacaacctgaagaataggagaaagtacttgtaaactttatgcatctgacaaagagttaatatccagaacatataaggaactcaactcaatagaaaaaaaattcagttaaaaaatgggcaaaagacctgcgtagacatttctaaaaagaacacatacaaatggctgacagatatatgaaaatatgcttaacatcactaattatcangaaaatgcaaatcaaaaccacagtgagatactacctcaccccagtcagaatggctgttctcaaaaagacaaaggataacaaatgttgggaaggatgtggagaaaggggaactcttatgcacttttgatgagaatgtaaattagtacaactattatgggaaacagtatggaggttctcccgcctcccccagaggcaggttctctctctgttgcccaggctggagtgcagtggtgtaatcatagctcgcttggcctcaaacttatgagctcaagtcatcctcttgcctcagccttctgagtagctgggactataggtgtgtgccacgtcatctagttagttcttaattttttatagagacagtgtcttgctatgtttcacaagctggtcttgaacttctggcctcaagcaatcctcctccattggcctcccaaagcactgggctttataagcatgagccaccctacccagctggaggttcttcacaaaaaaagattggctatatatccaaagaaaataaataatacattctttcatagcaaaagagaggatcagcatatattaaagagtgcttattttaccactgaacaagttgtaaaagtagacgttcttaagctcatgagcctgtggtaaatactaggtagtcactcaaaatgtgtagatttcaagcatactttggactttggaagtagacacatgagattgtagcacggaatcctaaaatcctaggccaaagaagacttttagaaatcatagttcatactgtttcttttatgcaggatttagctaatccatcttagaaaaaaaaaaaaaa

SEQ ID NO: 1958 - DNA, 1264 bp, Homo sapiens
  misc_feature (1101)..(1101): n equals a,t,g, or c
  misc_feature (1136)..(1136): n equals a,t,g, or c
  misc_feature (1152)..(1152): n equals a,t,g, or c
  misc_feature (1156)..(1156): n equals a,t,g, or c
  misc_feature (1159)..(1159): n equals a,t,g, or c
  misc_feature (1170)..(1170): n equals a,t,g, or c
  misc_feature (1175)..(1175): n equals a,t,g, or c
  misc_feature (1197)..(1197): n equals a,t,g, or c
cgtgtgtgtgtgtgtgtgtgtgtgtataatcattgataaagacaaactaattttttgatctaaattctaagttaatttcgtcacttgttatgtgtgtcttatttttattttgtcagaccacagataatttgtttcttactccttgactaccttcttctttttagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcaggtaaaattaaccttaggtactgaatggagtctttggtcaatactaggaactactgttcttttacagatcaggaactgtgtaaacagttgtcattaatttcatgaaacctcagtttccttgtattctgtatcaataacatttagctttttttgttgaacaccttatttcactgtcgtccgtgtgaagagaccaccaaacaggctttgtgtgagcaacaaggctgtttatttcacctgggtgcaggcggtctgagtctgaaaagagtcagtgaagggagatggggtggggccgttttataagatttgggtaggtaaaggaaaaaggggggttgttctctggcgagcaggagtgggggtcacaaagtgctcagtgggggagctttttgagccaggatgagccaggaaaaggaatttcacaaggtaatgtcatcagttaaggcaggaacaggccattttcacttcttttgtgttggaatgtcatcagttaaggcaggaaccggccatctggatgtgtacctgcaggtcagaggggatatgatggcttagcttgggctcagaggcctgacaccttagattaaagctgagtaaaaatgagtttttgattaaatagatttctttgagaatattgaatcaaataaactctgtaagaacttaaatttatgggaaaggataacagttaatggtttgtaattgagtataattggcttccttaaaaaatcctttgagactacttataacaaaagacataaagtcaaaatcacaggccttttaaatataccatgtgcangccagatgtgatggttcatgcctgtaatcccaccncctttggaatgctgangtgngangacggcttgangccangagttcaggggtggagtgagcngtgaccacagcacagcaatcccagctggatgatatagtgagaccctgcctctaaaaaaaaaaaaaag

SEQ ID NO: 1959 - DNA, 1366 bp, Homo sapiens
  misc_feature (758)..(758): n equals a,t,g, or c
  misc_feature (858)..(858): n equals a,t,g, or c
gaattccgtaacataaactgtggttctcagtctgttagctattcagatttttcacaatggtttttgatacgtaatgagaaataacctactaagtaaataggaccccttgctcaaagaagtgtgaaaagagcatttccttgctttcctgacatgctaggaagcaaggcaagcctaaggattcttctctgcttattcttttttctccctaggcacagttcgagtgacaactgctgcccatcttgcactgctggtggctaaaaacatctccttctttcccagcaatgtggagcaattttctgagggcaacattgatgtgtggtggattgtgcatgatggggggatgctatgctactaccattcctactgaaacagcacaaggtattttatacaactttttttttacaaaagtctttctcccttctgtcctggttcacaggacagacaaattcttcctctgattataatagtgttggggtttagaatcagaagagttggaagttattctaggctttcccatgatcccactttcaaacaagagaaatcattgtctttgtatttgatacctacttatctccaagtgaaattcagccaattaataaagttccatatgagccctaggggaaaacaacaagtgaacacatctttttttaaaaaatactgaaaacttaaggtatatgtatatgtgtgtattgcacgcatatatgcgctcattccgtggtaagactaattaaatgagatttaaaatagtaaatatatantctgcatgttgtcattgatacactgtctgaataaagtaccctcttaacgtatcgtgaaccatcttttcttttgccagtgttttcttgttatgaaattaangactccttaaaactgtattaaatgtggtgtttagtcaatcttttgccctaatacaataacatagcaagtrggaagctaggacaaatagccttatactacatatagcaaggtcttctagmccacaatgtctaatgtcttaggaaataaccttttttgcctccttgctctaatttttcacatgtgtatgtcactctctcaggtgtggcgaaagtgcagcatacggatcttcacagtagcccaattagaagacaacagtatccaaatgaagaaggacctagccaccttcctatatcacttacgcattgaggcggaggtagaagtggtggagatggtgagaaagctgagtttgagatacaagaggttcattcccccattcctctccctgtcttccttgaatcttttctggtttgggaaatttttcagatctaaatgtggattaatcccctagtgccaaaaaaaaaaaaaaaaaggaattcgatatcaagcttatcgataccgtcgacctcga

SEQ ID NO: 1960 - DNA, 2077 bp, Homo sapiens
  misc_feature (936)..(936): n equals a,t,g, or c
aattcctaagatgatagcagtaatgaagagaaatggaccttgagtttcagaaacttgtattctaatggaccttcaaaagatggcaagtattgtgtctggaattggtgggttcttggtctcgctgacttcaagaatgaagccacggaccctcgcggtgagtgttacagttcttaaagatggtgtgtctagagtttgttccttcagatgttcagatgtttctggagtttcttccttctggtgggtttgtggtcttgctggcttcaggagtgaagctacagaccttcacggtgagtgttgcagctcataaaggtggcgcggacccaaagaatgagcagcagcaagatttattgcaaagagccaaagaacaaagcttccacagcgtggtaaggggacccgagtgggttgctgccgctggctcgggcagcctgcttttattcccttatctgaccccacccacagcctactgattggcccattttatggagagctgattggtccattttacagagagctgattggtccattttgacagggtgttgattggtgcgtttacaatccctgagctagacacagagtgctgattggtgtatttacaatcctctarctagatgtaaaagtctccaagtcctcactagattaactagacacagagcactgattggkgtgtttacaaaccttgagatagacacagggtgctaattggkgkatttacaatcctttagctagacataaaggttctccaagcccccaccagattagctagatacagagtgctcattggtgcatccacgaaccctgagctagacacagagtgctgattggtgcatatacagtcctccagctagacataaaagttctccaagtcgtcacctgactcaggagcccasctggcttcgcctagtggatcccgcgccagggccgtgggtggagctgccnaccwgtcccgcacggcgcctgcacttytcagcccttggcagtcaatgggactgggtgccgtgragcagggggtgatgcctgttgggraggctcggtccatgctggagcccaccgccagggggctcggccatggcgggctgcaggtcccgagccctgccccgcggggaggtggctgaggcctggcgagagttcgagtgtggcacgggcagtctggcactgctgggggatccggcgctccctggcctgggtgctaagtccctcactgcccggggccggccggcttctctgagtgtggggcctgccaagcccacgcccacccagaactttcactggcccacgagcaccacacgcagcccgggttcccacccgtgcctctccttccacacctccccgcaagcagagggggctggctccatacttggccagcccagagaggggctcccacagtgcagcagcggactgatgggctcctcaagggtggccagagcagacgccaaggccgaggaggcgctgagagcgagcgagggccgccagcacgttgtcacctctcagtatgagtgtgttgtagtgtatgtgtgaaagggagttttgcaatgggagtatgggatgatgtgttagtcatagttctacagagaaatagactatctatctatctatatctcagagagagagagagagagagattgagtgtaaggaattggctcatgcaattatggagaccaagtgccaagatatggagacagcaagctggagactcaggagagctgtggcgtagtagtttctgtccaagtccagaggcctgagaaccaggagagccagtagtataagttctagtctgaaagctggcaggcccaagaccaagaagagcccaagtttcagtttgagtcccgaagcaggaaaagactgatattccatttcaagcagtcagacaagtcttatggcagggtcagccttttagttctcttcaggccatcaactgattggataagggcgactcacattagggagggcaatttgcttccaattcagctgtttatctcatcaaaaaacaccctcacagacacacttggaataatgtttgaccaaatgtctggacactttgtgccccagtatcaagcttatcgataccgtcgacctcgag

SEQ ID NO: 1961 - DNA, 1993 bp, Homo sapiens
ccagatatcaagataagaaaggtttgaaatgctcagtgttaaaataggatcacaggtcattgtaaaacagtcatttaaacaaagtgataagtcagtgatttttaaaaagtcaaaacctgtgctctttgattagcaggagactccatcaaagagtaagtttgaggagactgtatcaaagagtaagactccatcaaagactcacttttccaaataagacctaataaaggcagcatgagctcaagaaaatctctctctccctccttttcttttgtagtttactcaaaagtaaacaaaaccttttactatctcctgttaacactacctgaaaatcttgttcaaaagagaaaacgaaatcctacctttgtatcagtatattattaatattaaacctaattttaataaaatcttacaataaacagatccatctgatcccagtcagctttgaccagataagattttcatgaatcttttataaactcttacaattttaatttttctttctccaactttttagttttagctatatcatgtaaattttgaaacaatctttaacctctaaactaggcaaaattacttttcctttagcaaaactcacaccctcctctcttttttataactttcttcaccaaaaacacatcctactttcattgtatactttgcatacaagagtgtttcccatgtatctagtacttttaattacatatattaactacgattttaactcttagtagttctaatttcaagtgaaaaacctagaaagtaagtagtagttaactggtttatgtctgtatttgtagacaaatcatttcatggtttcgtagaaagatatttctataaaatataattgatgcctacttttttgtttattaacagatctaaagattattaacagatctaaatatatttagcttttttataccatgtaaaaacaaaataccaaattatgtaaactaaactaaaacatatctaataattaatgtttttgtatcttaatgtatgtagaaatgactcaaacattttatgattatctattactttattaaacctaacatgacttcaaaactttaaactactgaaaagaattttgaaactgcaacacagatacccttcctaatgtcttcctcagtcatactgagtcgcaactacccacgtggcacccaagtatgattatgaaggggcagggcctatctgagtcctgattttacacacccataatggagcccaggacagaggacagaactgtgaagataatgtctgactcttcccaccatagccaggagacaacagccaggccagagggagtaccacatatgtctgcagtcctcacttgttagagcccagaatctaatgagtctaatacataagctcacagacaagtcaaataagcatcaaacatatcacagaagcaatagttttatgagcttcagacatctagtagagaaagcctaaacctttctgaccagcagacccaggcaaaaatgtctgattgtgtttaaaactgacaagtctgaagacattctaattttattttaccaacaattaaaaagctaattttatttctcaaagattactaaaatcacattaacttgaaaaatatttgggattattaagctatgagcattaatttgtcagtttggtaccatgtaaacaatatacaaacagatctgtacacatatatacataaaaatacaaacataagtgaagatttcatagctttgatataaaaattctagccatgagacaagtaaaactcgctattttaaaaggacattggattcaaagttcataaatagaacaagttcaagtttattgtatatgcctgaagcccttaccaagttttaaataacaagtagcaaatttatatttcaagcacagagaatttaagctttccaaaaggccaattcaattttacgttatctttggcaaaaatcatgttaacagaatccaaaagagtaaaacataaaggcctttcttctacaaaaaaaaaaaaaaa

SEQ ID NO: 1962 - DNA, 1932 bp, Homo sapiens
cgcctccatgggtctgcaagacttttgctccgtccagtgccaaagccttagcagatcctggcatggatgcctcaggctgatggcaccggccttgcaatgagacgagaacccaaagctcagttatcagtgtcctgtcttgctgctatgagctttttgtactgataacgaccatttctttactgagcgccttctgggttctggcagcatcctcggcacccacattatataatttaaccgtcacaacggccagcccaggggtgctgctataccacttcacagagaggaaactggctctcagaggcttcagagcctgtccccagcttcaggtgtggctccctgagttgggggcttcctaggtgaggtccgaggaaacctgctggccaagtgacctggcagggtgtggccagtgtggccagggccgccgagcttgctttctttccctgcagcaggaacccttctggggctgtgatcctgcgatggtgcctgggtgggagtgggggtggggggcgggatggtctccctacctgccagcttcttggtttgaggtgaggacagccccggaagctcagacttggctcctgtccatgtacttggggccatgagctctgcagggaccttggaaagagagagacgggtggtgtagggcaggggaaggcattgtcttcaaacaggaaaaagctgagaatggaaacaggcgaaacttaccaagtgtaacatcacctggaactgaaggagggtgggaaggttttaattattttaaaaatagagatggggtctcactatgttgcccaggctggtctcaaactactgggctcaagtgaacctccttcctcggctcccaaagtgctgggattacaagcgtgagccactgtcccagcagggaggtgttttttttaaagctgattcactggaggcagggtgggcaagtggcactgctggtggccacccctcacagtccctgctgcccccagtaccgcctggcacccatcccccgggcccgccacgactttgcctgcgccagcctgatcttcgtctgcatcctgctcgtccatgtcctgctcatgcccaggtcagttgcagggaggggtgtgggggtccggcctgctgggatccaggctggaaggtgactatgaacctgcaaggagctgtgtgatttgggctggaaggggtcggctgctggggtcctagcaactggaccaggggctgtggcagcacaccttgagttaccaacacttctttttaatagaatgtgtgttttctgccacaggcctccctactccctaacgtctctctcctcagccacctgtcatatgtgtggcctgcatgcattttggttgacagcccttgccttaggtgtttggagtgctaggaggatagactctgaaaactgtaggcgccatcctttttctcttatatatagggaaattggggcacagaggattaatgatttatccaaaactcactgagattcatgcttctggctctagggccctgctggtggggtatagggatgagggtgaagtcagagggaagggggatctaaggtcagctacttggtgctttctagaagagcagttaggccgaagcatcgaccaggattgtggttttggctatgcttactaaagacataatagggaggctgtgcgtggtgactcacgcctgtaatcccagcactttgggaggctgcggggcgaatcactcgaggtcaggggtttgagaccagcctggccaacatggtgaaaccccgtctctaccaaaaatacaaaaattagctgggcgtggtggctggcgcctgtaatcccagctactcgggaggctgaggcaggagaatggtgtgaacctgggaggcggaggttgcagtgagccgagatcatgccactgcactccagcctgggtgacagagtgagactccatctcaaaaaaaaaaaaaaa

SEQ ID NO: 1963 - DNA, 1541 bp, Homo sapiens
  misc_feature (282)..(282): n equals a,t,g, or c
  misc_feature (335)..(335): n equals a,t,g, or c
aattccgcctttgattccttccctctgaagacagacaaaatcctgacttaggcagtattttttaaaataccaagggtctcggaaacctagggtttgataagtaagaggaacagatcaaattctaaatctcctttgtccacattgtcattctccagcttgttgttcttttcagtggtgaggtaagaatataactcctacttaatgttcctgttccttaggtgaaacactaccaccttttgttcaaaagttagatgctggggttgttgctgttgttgttttctncttttcttccttactttttagattttgatggagacgtggtaggaagtctgggnctgggaaatgaggtgaaaaagaaaagcaattagtttgtctttatacaaaataaaaccttctaaaaaaccttattatcacaaaaaagagctctacaaatctagatagttgttttgaagaagagaagagaattgtgaaaaacatgtataatttgggagggctgggcacagtggcttatgcctgtaatcccagcactttgggatgctgaggcaggcagatcacctgagatcaggagtttgagaccagcctgsccaacataatgaaaccctgtytctactaaaaatacaaaacattagctgggtgtggtaacacacgtctgtggtctcagctactttggaggctgaggcacgagaatcgcttgaacccaggaggcagaggttgcagttagctgagattgtgccactgcactccagctttggtgatagaacgagattccatctcaaagctaaacaacaacaacaacaacaataacaacaacaaaaacatgtataactgggaaaaaactgaaagagaatgcaggatcataaaaatatagcaaacaaagtgagtgggatttaaaattagtggaataagaaataatgggtaacaatgaagaacataatttaggtaatagtatagtatcttgggagccctcctggaagtatctagttatggacagtgagcagcagaaacaggatgtaactcaattcagcatacttgatggttgtggtaaccctagaaaatgactccaggaaataggtgagaatccaatcagattgagaggstaatgttcatgacaggggtgccctagcagacaggcaaagctgaatagaaattcaggaggagaggaattttggctatttagtaaaattatgagcagttggtcataggcaaattttatgagtaggtagcccttctgaagtcttaggcatataattaacctaggttggaattataattagacatcaaagtttaaacttttttatctgaaccgagatgcaaaagtaaattggttctgtgttctggagaattgtaaaagaattccttaattccttagcaaaatttggaagtcagtatcaagtggtgaggataggaaagttgaagagactgtggaccaggcaagaccttatcagttgatttaggaagcagcagtgacagaggccagacaggtaacaagaaaaaaaaaaaaaggaattcgatatcaagcttatcgataccgtcgacctcga

SEQ ID NO: 1964 - DNA, 934 bp, Homo sapiens
ctcgaggtcgacggtatcgataagcttgatatcgaattccttttttttttttttttttcagtggagaagaagggagagagagaggaagtagctggaggcaggaaacttgtactgatccatgcacctctctacttgttctctttgtcatcaagggcaccatatagctgaaaggcaggaggatagggagagggccacctcttcatatcacttctgtgccttggaaagctcttctccctggataccaccggataaagacctacacttctctccttgttgtgtgcacctgttcactggagcacatgcgcccggacatgctctcagaccttgcttcctggccatgagctttaaggaatggtctctgaaaatgcactacttttaagagctgggtctgaagcagagctaactggtctgcagggcaatgacacccttgacctcggsctcattagctccatcctcttacctactgagctcacaaccaccaacatcmtaatacttgagagaaagctcattacagcgtatgcggtggcacatctgtatttacttggtttgcgagcagctctcagagtaagccagctttctctattgctgagctcctgcaaatgagaacaacaaacacacctactgctgagtcaaatcaggccaaagggaaaagaggaaggatctgtgaggaggagagaccataagcctccaatcacactcaggaataaaatggggctaaattccaaatgagattaacaaaaaaaataatgagagaaagactaagagacagaaagaaaacccatcacataccctttgtatctgaaaggcaggctaggtaatatattccttgccttaatgtcaagcttcagtaaacccaccagccactccagagaagaggaggtggtgcatttccggcttgcataatagccaccagccaccaccggaattcctgcag

SEQ ID NO: 1965 - DNA, 1625 bp, Homo sapiens
aattcccaagaaaaatctgaactttggcttgagtttccaggacttgtagtcaagtatttatgtgggttgtgaggggataagagaatttagggtagctttatacagtgttaccatttattcttttttgttgttttatttttttcttatgtttggttggtgtcaccatttattcttttgtatgctgtttagcctctggagagggcatctctgtgtttatagaagaaaaatgtgactctcatgttgtacacagccctagactggacatcaaggtcttctaactgtcctaagcttcttaggaagatattgtctatgtattttagtttggaatcagactggcacaggactcggcatgcactatcactcttactgttctattttttcagcttggatttacactgggcaacgtggttggaatgtatctggctcagaactatgatgtaagtggccatatccatgacttccttgattccatgtaactgttttagagtgacttttctttgtttgaggtaaggtgtgacttccagcataaatgtagtccatatggctgaggcaaaactcctgaatattgtagaatggtttgccattgkttgaaaaagtaatccaactcatgaaacagctgtcctccatatcaccacaagagggcaaaatcccttcagtttagctgggctcatgatcatcctcagctgtggcttgttagccgagagtaatattaagttgggctcttaaaattctttgggaaatcatgtgataagtgagaatttaaaaattaattggataatattttcaaccccactatccagtagtagagatgacttagaattttggagatgcatctgggtagggggactgaaaaatatagatctatattccatctccaaaattctaagtgtagcacatttggggacagagttttgtgaagttgtattaacctcactttataggtggtgatgttgaaaaccaggtggtgcagcagcctatgaatggggattctggacaggagtttgaaaaagacaagcaagggaaacatgatactaacttgatttgttataaagcttttcatatgacaaagggaattcctttgtcaaccttcgtttgagtcatacagttttctaggcaaaggctacattatgtcacatttattgttwatatgcacaacctttacttggcaccagatcgagcggaagtgggtatacaaaagtagaagtgggtttcagagaaggagcatacttatctgacaacttctgatatctttcacatgcagttataaggctaagaaataccactattggccgggtgcagtgctcacgcctgtaatcctagcactttgggaggccgaggtgggcagattgctcaagctcaggagttcgagaccagcctgggcagtgtgacgaaagcccatctttacaaaaaatacaaaaattagccaggggtggtggcatgtccgtggtcccaactacttgcgggattgtggcgggaaggatcacttgagctctggaggtcaaggctgcagtgagctgtgtttgcaccattgccctccagcctgagtgacagagtgaaaccctatcttaaaaaaaaaaaaaaaaaaggaattcgatatcaagcttatcgataccgtcgacctcgag

SEQ ID NO: 1966 - DNA, 2128 bp, Homo sapiens
gcgccgcgagggggcgactcccggggcaccgctggctcctggcgggagctctgcgtcttccccgcggcaccaggcgctctcagcgggctggccggttccacgccgcmagccagccmcgtgtgggracttcggtctagtatttggacccgaggagataatwctgtgtgrraaattctctcccttcggttggaaacagtaacaaactggaaacggatgaggwgttatrgacgtgcttggaratgcaagaaaccttcagattacgagccgttgacgggaccagttgtatttcacgtttttcgaattaagctcagaatcagttttcagaatgacatgtgatgcgtggtgcgtggtgtgtgtgcctgtgtgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccaggragaattccagcttttttttttttttgagacattcatgtgaatttctctgcgaggggaaagaagmccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagargcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaataaaaaaaaaaaaaaaaggaattcgatatcaagcttatcgataccgtcgacctcgag

SEQ ID NO: 1967 - DNA, 1309 bp, Homo sapiens
attagcatatccatcatctcagtttttcatttctttgtgttgggaatgttcagtatcctcgctatctgaaactatgaaatgtgttaatgttaactatggccatcctacagtgccataggacaaaaatatggaagtcttcactagtttgtgtgtcatccttgcgcaggtgccatgctcatcttcccagtattattccagttttagtatatgtgctgcctaagcgagcatggaaattcattttagctgtaagtttgtgctgggcagattatccaataaaagtgcccttgtaatctaatagttctgaaatagccttgtgaatggcagatcccctgactgccctgtctgttctgcacccagcctgccagctttgccttttccactgatgtttttgtgggatgcagtggaccccagaagaacagtacctcagatttcaagcttgtgacccactagctcagcctggccaggttaaattggtgtcttaggttccctgtagaaagggtctgtgattgtcaacctggctgcgtgggagtaaagaaggtgatgtctgtgacaggcccagcactcagggactgagtcctgcactgatgcaggagctgtgtactcagcagtgtagtcctagcctccttccaagagtcatgaccctgctcaagatctgattttgcaaggcagccctttccagagcgagaagactatatagttagaaagccattccttatattgaggcaaaataggcctccctgtaaccttcatcttacagttttgtttctggtttttagagcaagagagtcaatctcataatctgcagcatgagaattctttttactcaccagtgaagcattcataacctctgtcaggcacctgcttggaattacaggtttacacagttaatcggaataaatcctgtcttccaaagcttacattstaatcatatawaattcagtaaaaagtgatgtcaggacacagattaaaaacaaaatcatgggaccaggcacagtgctcacgcctgtaatcccagcactttgggaggccaaggtgggcggatcgcttgaggtcaggagtttgagaccagcctggccaacatggtgaaaccccgtctctactaaaaatgcaaaaatcacccaggcctggtagcgtgcgcctgtgatcccagctactcaagaggctgaggcaggagaatcgcttgaacccaggaggcggaggtttgaactgagtgccactgcactccagctgggcaacagagtgacactccatctcaaaaaaaaaaaaaaaggaattcgatatcaagcttatcgataccgtcgacctcgag

SEQ ID NO: 1968 - DNA, 1686 bp, Homo sapiens
ccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaatgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaggaattcgatatcaagcttatcgataccgtcgac

SEQ ID NO: 1969 - DNA, 2153 bp, Homo sapiens
ccattctaaggaagagcccttctttccaccccctttatttacttatttatttctctctctttatatcattatgaactcagggattcttaatttatgtacttattttgatgcttaaattgtcccatatgtggtctgtgagccacccttaacactggttcctttgctctttgatatgcctacatcatttttttagtacttttttgttttctagcaaaagttgtttgaagcttaccatactgtatttttttattgtggtaaaatatactttaacattcaagttacctttttaaagcgtgtggttcagtaacatccagtgcagttgttcctcagtatccacgggctgttggttccaggactcccacagatactaaaattcacactcaagtccgttattttatataagtgtgagatcttagataacctatgcatactctcccatatactgtaaataatctctagatgatttgtaatacctaacaaatgctgtgtaaatagttgttacactgtattgttaacagtacagtaacagacctgtctgttcagattcttcctggccttttaggggatcactgacaaaaaaacttagtgcatgttcagtacagacaaccatcctttttttgctttcgaatatttttgacctgagattggttgaatccatggctgtggaacccatggacacagaaggccagtggtacatttacagtgttacagagctgtcacccctgtcgattccagaatttttccatcattccattagcagctcctccccagcctgctctgctccggaccccggcagccactatctgcttcctgtctctgtggatttgtctacattagatagttcacagaaatggaatcacaatatgtgagcttttgtgtctggcttctttcacttagcgtgctgttttcaaagtccatccgtgctgcaccatacatgagcgctttattccatccatgctgtaccatacatgagcgctttattccatccatgctgtgccatacatcagcgctttattccatccatgctgtgccatacatcagcgctttattccatccatgctgtaccatacatgagcgctttattccatccgtgctgcaccatacatcagtgctttattccttttctggctgaataacatcacattgtatcgataggtcacatctggtttctccattcaccaaacattgggcatttgggttatttccaccttttggccgctgtgaataatgctgctatgaacatgggtgtacaagttttagtttgaacacctgcggtcacttattttggggtatatacctgggagtggaactgctgggtcatgcagtaacttgaagtttaagttactgaggaattgccggactgtttcccacagtggctgcagcagcttttattccagttagcaatcacgagagcttcccaccttctcacctacacctgtgatctgcctctttcgttgtagccatccctgtccatatgagctggtctctcatcttgccgtgatttgcatttccctgatgactgttgatgttgagcatcttttcatgtcctgattgaccatttgcgtatcttctttggagaaatgtctgttcacgtgctttgcctagtttttaaccgggctgtttatcttttgttattaagctataagagctctttatattccaaatgctagacccttaacagatctgtgatttgcaagtattttctcccattctgtgggctatctttttactttcttgatagtgtgcttctacaaaagtttttaattatggtaaaatcacatttattttctcttttgtaacttttggtgtcatgtctgagaaaccattgccaaatcaagatcacaaaaaattgacgaggccaggtgcagtgcctcacacctgtaatctcagaactttgggaagccaaagatcacttgagcccaggagttaggaacagcctagacgacatggtaaagccccgtctctacaaaaaatagacagattagccgcatgtcgtggtgtctgcctacagacccagccactcaggaggttgaggtggcaggattgcctgagtctgggaggttaaggctgcagtgagctgtgatggagccgctgtactccatcctgggcaacagagtgagatccgagaccgtgtctcaaaaaaaaaaaaaaaa

SEQ ID NO: 1970 - DNA, 1790 bp, Homo sapiens
  misc_feature (99)..(99): n equals a,t,g, or c
caaaaaatacaaaatagcaccacagtctccatctggtttatagcaacaraggtactttatttaatgaagcaatggttctaatcctggatactgccatgnactacaattccatccctcccagaggrgtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacaatctcagtgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttyacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaaaaaaaggaattcgatatcaagcttatcgataccgtcgacctcga

SEQ ID NO: 1971 - DNA, 1319 bp, Homo sapiens
aattcctaatttttaatatggtgaccttacagaaaatatttcccaaacatccttttcatcctgtgcttctggaggactgatttgtttgagggaatcattctatgcattatatcctaaaatattctatgactggtttctgtccatgtttgtgggctttcatttttttaatgggatgactattagtcaaagtcagcttgtcatgactcatcataggctttctaacctacttccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgagaaaaaaaaatccacattaatattgaaactgcacctgtaatcccagcactttgggaggctgaggacagaggattgcttgagcccaggagttcgagagcagcctgggcagcaaagtgagaccccatctcctaaaaatttaaatgtatttattaaaactgttctctagaagctttggactgaatcccaaaagtgtttataagttcaaaagccaaaagtatttgtaatttcaacaaccaaaaatggatttctttatgtaatcttggaattattaaaagtccttttagcttctagcacatatttgtacaaagagtttaaggactggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcgggagaattgcttgaatccaggaggcagaggttgcagtgagccaagatagcgcctctgtactccagcctgggtgacagagcgagactctgtatcaaaa

SEQ ID NO: 1972 - DNA, 1504 bp, Homo sapiens
tgtagtttcgtttttaaacatttgaggatattttaggtgatttaattcattgtagaacatagactgcatgatttcacttgttttagattgagattgttttgtagcccaggaaatgttttatcttggtgaatgttccatatgtacttgagaagaatgtgtattatattgttggttgtagtgttccataaaagtcagtttagctcattggtagtggggcctaaatcatctgtatcctaactgatagtgtgtggttgtgtgtctttgtttttctttgtcccatctgctttttgggttctttgattttcttctggtgtttcttcttctggattaatcaaggattttataatattcagatttatctcctctgttggggttttagctgtacctctttattttttaagaggctgttctagggattacagaatgcattctcaatttatcataaaatagcaagaatattataccaccttacatgtttcacatgtaataaaacatactttcatatactattttcatcctttgtgcttttattgtcataagttttgcttctaaatgtattatagttattgtattttgtgattatttgtgcttcagaaagttattctttgaagaaactaagaaatgagaaaaattaacatctacctgtatattcaacatctacatatatatttaccatttttgccattctttattcctacataaagatcaaagtttacatctcatatcattttctctcagtctgaagaacttgatttaacatttcttgtattgtaggtgtcttagtgacaaattcttcagcttctgttttcagcttttatctgaagatacctttattaatctttactttttctatatattttgtttgttcgttagagataagtctactctgttgccagctggatccatggccgatcataacccactgcagcctcaaactcctgggctcaagtgatcctcccacctcagcctcccaagtaggtgggactataggcacacgctaccgtgcctggctaattttttaatttttttggagagttggggtctcactttgttgcctgggctggtctcgtacccagggctcaagcatcctcctaccccagcctcctacggtcctgagattacaggtgtgagccaccatgcctggttatttaaaaaaatatgttttgaataatacagccaattctgtttttttaagctgtcactatgttctgtatagccaccaaaaacagggaattagcaaatactgaatcattgttcttaggggaaatacagacttggctcctgtaagcctcttgtcataatatttttgttaaccaatcagtatattaccttgttttatgtgtttttctatttaaagccacctggggtacaaaaatacagttggatagaaggaataagttctagtatttgatagtacagtagagaaattatagttaatgatttattctatatttcagaatagctagaagaattgtaatgtttctaacacaaaaaaaaaaaaaaa

SEQ ID NO: 1973 - DNA, 1645 bp, Homo sapiens
attccttactgtgaatagttgctttcatactacagcagcaatgttgaagagttgtgacaatgaccacatggcctataaggcctggaatatttgctgtctggctctacgcagtttaagtttgctgacccctgtgcaaacttcgtcaaaggtaactttgacttactgcgtactcttgattagtacccaaactctctaaagttagatattaacttagaaaaaattgataagtttcaaaaaaaaatttctctttggtagggaaggtaactccaagagttaacggttttcttgccttgaagggcgttatccagttttgtatctatctctgcagtcttatttcccattgaccagtcttttttccattgactgcatgtgtcagtttctcatgtcctgctttgagccacccattgtcattctgcaggtcccttcattaatgaattaaataaatcttagacacacgctcactatatattccaatgagagtgtttattgtatggagaattatatgttgtctccttgaggcttggcagtgcctcttgaatgtagtcatttaaccctcttgggcctcaggtaacttctctgttaagtggaaataattatccccagtaccttagccaaattactgtctcacccaaataataattggacatagttttgtaatttaagttaaaagatgttatgtttatgaaagagttttgttagctgcaaagcgctatttgttggatattgcttcttgaaaaaatacagatcttaggtattaaagaataggtagaagcctgttaggtatgaattatgaacagatattcgattctttgacttctccattcagaatagttatttttaaaaagcaaatatgtaaagatctttctgctcttaagcctaaccactcatctgatgagtgtactgaaaatagaagtggtttattgcaatatgtcagagaagtattctactgataaccacccatacatgaaatcttaaagaagtagttatgagttggaaatttctaggttgtaatcagaagagggagcaaatgacagaatacagctgtgcattgtttggaagtgggctggaaagaattcattgcctctttaattgaagaaaagcaaagagtgacactaatcaaagtaaaagaagggaagtactcatagctgaaaatggaactataaattgtttgctttttagagcaacatcagttctttgaaacccatacagttccttataatattccaaaacaaactgccatatggaaacctgtttagaaaggaataatagcactctaccctcctccccagccactaaattgaaacatacgtgaaaatttaatgtagttttttaatcaagctcagaaaattttttttttttttgagacggagcctcgctctgtcgcccaggctggagtgcagtggcgcgatctcagctcactgcaagctccgcctcccggtttcatgccattctcttgcctcagcctcccgagtagctgggactacagcttggctagtttttttgtatttttggtaaagacagggttccaccgtgttagccaggatggtctcaatctctcctgacctcgtgatccgcccaccttggcctcccaaagtgctgggattaccagcgtgagccaccgcgcccagcccaaaaaaaaaaaaaa

SEQ ID NO: 1974 - DNA, 1466 bp, Homo sapiens
caaacacatttctcactttttttttcctgaagtatataagtctgtgaataaccatggtggtaaaaacagaaaggagaaacagaacgagaaagaaagaaatagaacaatcaatagaatatagtaatattatcaagctatgtcttttgattaaaatgtattatatggtttaccttgattaaaatgcattatgtgtgcagttttctcaaaaaaattcttattgtgtttwattgttcagtcccttgtttattctcarctgtgtgtccagttactctatccatcttagactataaactcatcaaggcattaamcatgttgttttctttattcctgaatctcaacatctagttaatgccaggcaggctgtgacagtcaataaatgtttgctaattatgtgatgatgctttgggacataagaatgttgctttgtgtctctagggttttagtttatttttaccagatcaaactttagaattcgactaacactaatgtcagaagtctgtgtttcagtaaccatctacagataatggcacccagttgtccatgaggagatgccatttgcatcctgtgtgggtgacagctatgctttgattcctcttggatctgtaggactacttgcctgtaagacctcatgtattgttctgggggtctgccagagagggaagctagcctcagaacacggggaaatgaggcaagggggcttcagaagtggtcatgtcaggattctggcttggcaaagagaaaggcgtgggttgttttatgttccaaagctggagttatttcttctgtgaccctggcatgtcttcatacttaacagacaccaatattgtcctttccttggtttagccaaaaccgggggttagggtgggtagtaggaggtgaaggagcttttcttcagtatgtatgaaggggattgacgtaatatctgctttcataaactgaatctccagtgagccttcctttaaaaaataattgtatgtaaaaaccacataatgattckgtaattacagtgtgttggcacagttgttaaattataaatttaataagctaagatgagctcagtaagagtataggcttttcactggagtgaaaggacattacttgatgagatacagcagagaggaaacaatagactttttgtgtagctgcctgaaacttctgctaggtgaaggcaagccaataaatgaagaagaagggataatggattgcctaacctgtgaacttggtcaccatgttctttgaaaacaaagtgaaatgcaatgtgttgtctttggactgtctcacagtgcttaccctacatcagacaacccttgtctagtatttcacggattttgatttgctatttattttgcatttgccttcatgttgctatgttttaagccatgaaatgaattatttattctgtttatacaagcaaaaaaaaaaaaaaggaattcgatatcaagcttatcgataccgtcgacctcgag

SEQ ID NO: 1975 - DNA, 1828 bp, Homo sapiens
catcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttatttttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttccctgtgttgggaaaattgacaaataataaaactagagaacaaacaataatgcttctgtctcttttacgaatggagagagaaagtttatattcagtagagttattgccctgttcatttgagaggggcatggattttctgtttaagtccttcagggaatcttcagctaggtggtaaatttaataagagtttctaaaaattgaaatgtttaacttttaaatattctggagatagaagaagaatataaaatgaaaccaggctgatctgcatgcagtggcatttacaactaactgatcacaaccaattatagattccttattttgtttattgtgaggcagagtctgactctgtcacccaggatggagtacagtgcatagctcactgcagtcttgacctcccaggctaaaccaatcattccacttcaccctcccaagtagctgagaccacaggcacacaacaccacaaccagctgattgttgtactgtttgtatagactggatctcactatgttgcccagactggtcttgaattcctgagctcaagcagtcctcccacctcagcctcccaaagtactgggattacaggcgtgaggtacctcgcccagccccagttacagatttctttgttccttctctctcccactgcttaacttgattagcctttaaaaaaaaaaaaaaaaaaaggaattcgatatcaagcttatcgataccgtcgac

SEQ ID NO: 1976 - DNA, 2746 bp, Homo sapiens
  misc_feature (2)..(2): n equals a,t,g, or c
  misc_feature (10)..(10): n equals a,t,g, or c
  misc_feature (26)..(26): n equals a,t,g, or c
  misc_feature (35)..(35): n equals a,t,g, or c
  misc_feature (2736)..(2736): n equals a,t,g, or c
cnccgatgtnggaccaatccccctantagccgcanactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctsttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaayggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggraacagcaggcayggtgaaagtaacgtctgacagaagcatgtgcacttcgggaagcaggcctgcatcttacctgtacagtatttgcattccacagatggarcggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcartttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatccaaaaaaaaaaaanaaaaactcga

SEQ ID NO: 1977 - DNA, 1507 bp, Homo sapiens
ccgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctcttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaacggatcccaaagtcagacccactcgctacaagccaatgacactttcaacaaacagcagtggcttaactgtattcgtcaagccaaagaaacagttctgtgtgctgccgggcaagctggggtgcttgactccgagggatcgttcctaaatcccaccaccgggagcagaaagctacagggagaaacaaaacttgagcagatggaccaatcggacagtgagtcagactgtagtatggacacgagtgaggtcagcctcgactgtgagcgcatggaacagacagactcttcctgtgggaacagcaggcatggtgaaagtaacgtctgacagaagcatgtgcacttcgggaagcaggcctgcatcttacctgtacagtatttgcattccacagatggagcggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaaaaaaaaaaaaa

SEQ ID NO: 1978 - DNA, 1597 bp, Homo sapiens
aaaaaaaaaacaagtgaaattgagaccacatatttagatatagggcattagaagatccctgaagcttaagcctcattagcttcatggcaaatcttcccttgatcttgataatgctggtggtagggatgatgggggtgactattaacacattgagcactcatgtgcagacattgttccaagcagtttttatatattaatcctcgaaacaacccaaggcacggtagcagaggtacagagaagtcacacccaaggtcacacagtgggaagcagagtttttaggagagggaagaagggcagtatggaaaagaatactaaactgagagcagaggccttcatgaatgtcagcttcaccacccatctgtggggaacctggggggaaaatcacgtacctttttgcatgtacgtccttgacttcacctgtgaaaaaggaatattgatgcatgtcatgaatccttgactctgttgttctgaagktkagagaatgtgtaaaagtgctttgtgaaggtaaartgcttagaaacgtagttatattacacagctttctcttccacttcaatacttaaawttcaggcttaaaaattcatttagttttgcttttcatttcacttctaatgtgtctaatttatttcttggacatgatttttgttctcaggttacttgtctgcaagacttttttggtgatgacgatgtttttattgcatgtggaccagaaaaatttcgttatgcccaagatgactttgtcctggatcatagtggtaaggcaattcttcagctaattcatttttccatctttgtaacccctgaaatgaaggcttgggatttagccactcagttggtgcatgttaagaagtctgacatgttgaggaaagatagcattggcagtacaatttttgaaccaatgaaaataaagaataacatgaaagcatttgcctacttataaaaaaaaaaaaaaaacgtccttctcagcctgccctcgacaacagtgaccaacagacaggcagctgggtttcccaggccatccctctgttgccatcagcttgattggcttccccgagggccagcagggctgggggctccggrgacagcaggaagcactcccagccaccagtgcctgtcrcctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaaaaaaaaaaaaaaggaattcgatatcaagcttatcgataccgtcgacctcgag

SEQ ID NO: 1979 - DNA, 1294 bp, Homo sapiens
  misc_feature (668)..(668): n equals a,t,g, or c
catcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgarggaaagaaagcccyttgctttggtctgtcctwatgtaccatattattagagactttccgacancctccccatttttwattycttaacagctaatacgatagctgtgcttycataataaattcaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaaaaggaattcgatatcaagcttatcgataccgtcgacctcgag

SEQ ID NO: 1980 - DNA, 2284 bp, Homo sapiens
ccgaaaattatctgaaattcaaatttcagtgtccttaagtaaagttctattggaacatggccacacatttatttatatatcttcttgtggctgttttctgctacagctgcagcgtcttatactaaacagactgtaaggcccataaagcctcaaatatttactttatgggactcgatggaaactttactgacccctgatctcagtgtttcttttaagcattgcaaagatagtttgcaaaaatgctatgagagctctatgatggcattagatacctaaatgttagccagctgaaaaaaatttcctaaagtggtattaggcctaaaaaaaagtgattctagggctacttaaacaagaagtttttacagcaagagttacatcctctactcattttaatgtctaggtaagccagagctttaaatcctgtattaatttacctgtgaaaatatttcatattctcccttttgtgccgtgtgtgcgttggattccccagtgggtgtatagatgaatttataatttatgtggctggatggaagcctgggtaaatacaagcataaacaacatcaggcaatgccagtcgatagactgcgattccaggatgtgttctgtccaggcctgccgttcattccaaaggcttgcatttcaaaactgcaggcttggacctgggactgctggtaaggtggatggcagggttcacatctggttgggcttaggaaggtaccaggagagtgcaccttctagtacttgaaatgtccctccattttgaggacacaggagtggcctacctttcatctaacaaagacaagagaattgaaagctgattgtctttgtctttgaagggtttattgctttacctcttcacttcacctggctttggcacctctgtcatttcttcatttactgttttttctagcatacttttaacttctttttgtactttctctttccaactgctgtccacatgccacctgtgtatagaatcccaagaaaacataacccaccattagaattttagttgctaaactatataagaactttgagctgtagattaacatcctctaccttcctttggtgccatttgtttacccctttttccgaacaaaaaacaatacctgcccctgttccaaaggtgtcttactattccaataaagaatgcatgcctgggaataaaaagaagcttagactactgttccaatggagctaagtgttcaaagaaattcctgaattcatttcctgggggaaaaaatgtggttagtgacctggaaactactaacaacttataaaactcaatactctgatggcgactctgttcgctttacccctaagacatcttgaaaggaaagacttttgtcagagttgggcttctaaagttttaataggaaattgaggcactttctgtataattcaagccaaagatttttttttttctgggtttgaatgattggataattgcctcaattctctgttccatgtaattgagatcacttgactcttcttagtgctaataaagagatgttgggattcacggtttattaaccaaacttttcagtttgtggacctgtcattcaaaactgcaaacaaggctgatcccatgcaaaatagactactgcctttatgctgtactaagaatcagtccctcttaaaggatgcatttataacctttatgcaatgaggaaatttccaggtagccaattttctttatagtgctaccagccttcagcaagcttaaactctgccctgcaagcctgaaaccctgcttctctaagattctacataacaggagattaaacatccaaatgtgtataatcgcattctggacagtatgaagaagctgtcttggaatattgttaactattagaatacttaaagtgtgcacatcacccaatttaggatttcttggtaatagtagcctatactttagaaaattaaagaggaggaaggggccgggcacagcggctcacacctataatcccagcactttgggaggccgaggtgggcagatcacttgaggtcaggagtttgagaccagcttggccaacatggagaaacgccatctttactaaaaatacaacaaataattagccaggtgtggtggcctgtgcctgtaatcccagctactttggaggctgaggcagggaatcgcttgaacctgggaagcggaggttgcagtgagccaagattgcaccactgcactccagctagggtgacagagtgtgaccctgtctccaaaaaaaaaaaaaaaaaaggaattcgatatcaagcttatcgataccgtcgacctcgaggg

SEQ ID NO: 1981 - DNA, 1395 bp, Homo sapiens
gccttcctgaccctagatgggctttgtaaaaagagcaagtcgtgtgtgccagcctgtgcagcagtgagggcacaggcagcaccagggtcccgggtgtgtgggtgctgccccagcttgcagtgtggtctcctcggtgctggccacagctgtgggtccccaggaatattgtgctgcaggtcttagacagatttgggtactactggttctctgttcagcgtggcctggacagtccacagatggtagtagaccatggggtgttgagatgcaaggagactctgccgttctttcacattctgcttttgctcctgacagcttaggaaagctctctttgaaactttggtatgtgtggacctgagattgaatgtatctgaaaggttgctaatttctcactgtccttgcttcccaggacgccaggaaagcatgtgcagatgcaactctctctcaggtaagagcccactgagtcacgcagagccatctgcctgtgaggaggctagcacggcacccacacctggagcctcgggagggctctgcttgcattctctgttgcgcagtgaggatgccaagccactgcttttattaagaagtcattctgatggtaggcataggaaatagaggggcttattgagataaaaatgagatatctcaagccttgaataatcatctacctgttacagagggtaatagttgtaaaatattgttattgtcttaagatattttgaagctcctctcctcaacagaatctgcctcagaacttctatttctaatatccaatttgataatacctcaaaaagttaaacatagaattattgtatgactcagcagttctgccattaaatatatgcccaacaggattgaacactgcttttcaaacacacacatgtacatagcagcaccattcacaatagccaaaatgtagaaacaaccaaaatgtgcataaatgaatgagtggagaaacaaattgtggtgtctctgtgccctggagtattgtcagccattaaatggacgtcagtacagtcagaggctgcaacgtggataaaccccataaatattacgatagtgagagaagccaaacaaatggctatgtattgtttagttctatttatatgaaatatctagaatagtaacattcactgagacagagtggactagtggccagcaggggtgttaggggagagagggagaggaagtgaacagggagtgactgctgaatcaatgtctggtctccttttggaagatggtttggaactagatggtggcagtggttttacaacgagtgtactaaatgccactgaactgtagactttaaagtgattaattggatgttacgtgaacttcaccttattaaaaaaaaaaaaggaattcgatatcaagcttatcgataccgtcgacctcgag

SEQ ID NO: 1982 - DNA, 1229 bp, Homo sapiens
  misc_feature (710)..(710): n equals a,t,g, or c
aattccctccatgccaggctaactcttttggatttttttagtagagatggggtttcaccattgttggccaggctggtctacaacacctgacctcacgtgatccatccgccttggcctcccaaagtgctgggattacaggcgtgagtcaccatgtccagcccacatacacttttaaaaataatagtttatcttgataaaatctgaattaagctgttgtttttatgaggattgtttctgactcctgtttctcatttcccttttcacctcccctgtcagacacatacactccacgtccacaccacacatatgcacactgcggacttcaccactcacattcactttactttgttaatctggctgcaaggaaatttcttagcccttgacacagtatgtgaagagagttctgttggcagctcaccatggtatttcaaatgtgtgcctcaaattgagagtgccggttggaaataacaattcactctaagcagtgcttttcattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgcagtattctcaggaattttaccagngtgggatcctggtactttgaggggagaaggataacttcawatctggatttaatttcygagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactatataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaataccattatgttaaaaaaaaaggaattcgatatcaagcttatcgataccgtcgacctcgag

SEQ ID NO: 1983 - DNA, 1166 bp, Homo sapiens
cgaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatggtagtgttttgtttgacagaagtaaatcaaatattatggtttaaatataatgcaaaatttcaggacagttaatttgggcttcccttaccctaaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcgtgcctgtggtcccggcactttgggaggccgaggtgagcagatcacagggtcaggggatcgagaccatcctggctaacacagtgaaaccccgtctctgctgaacatgcaaaaaaattagtcgggcatggtggcgggcgcctgtggtcccagctactcgggaggctgaggcgggagagtggcgtgaacctgggaggcggagcttgcagtgagccaggattgtgccactgcactccagcctgggcgacagagcgagactctgtctcaaaaaaaaaaaa

SEQ ID NO: 1984 - DNA, 2375 bp, Homo sapiens
ctttttttttttaagacaacagtaatttatttagctcctgattgtgtgaatgggcaatttgggctgggatctgcttgagtggttcttctggtcttgattggcctcattcatgtgttagctgccatgttggttgggctagtatgacttcagctaggaaagcatgtttctgcttcatgtggtctctcattctccagcatgctcactcaacatgttcatggctgggtaaggttccaacagacatttataaggcctcttgaaacctaggcttggaactggcatacagtcacttcttccacattctattgatcaaatcaagtcacagtgccagcccagattcaaatggtggggaaagagacttcatttatggaagggaggagctgcaaatttcattgccaagaggtgtggatacccagaaagatacatttgacaaaccatctatcaaagttactgtcagaggtatgtttttggaaatatcatttggagtgggatgtgtcctgtatgactggaatcgttttctatttgtaacagagaagcgtgcccactccttgcacccatagataacccaatgccgaaggatatgagagagagagatgtccagtttgtgcctctcccagcttcttgtccagagactccttggtttagattttgatacactacttagaaaaggtggagagtttctttaagatttcatccacagagggccgcacagagggatcatgggcccggcactcatcaatgatctcccgcagctctgaagggcagtcttcacccagtggctcctgctgccgcttcacagccaccagcttgcggatcttctcagaattacagccttgaaacgggatatctccagtggcgatttcccagaggacgattccaaagctgtatatttcagactttacatcatattgataaaatacatcttccagttcctgaggtgagagatatgctgtagatttgactctgtctgtcttttctctcgtagttcccaaactcatggaagtctgtgttttcctcaactcaaatcctgcaagcggtataggcctcgggctgcccccaggactaggaccatgcgcttgccaaatgtgaggtctttttccctatccaacagctccctcagggtcccgagttcacagtactccatgacaatggagaattgaggcggagtcactgtttcatcaatgcaaatcccaaatatacgcaggatgttgggagattcgaatttcttcatggttttgatctccttattgaaagtctgcctcactattgcaatgctgccagcctggagttttttgaatacttttatggccactggagctctgtggtattctcctttataaagtgtgctgacttcattttcccttagcagaatccacggggatcctgaaagctgctccttcttgatctccttgatttgctcttgcgggatctcctgcatgcattttggtggtaaatactgcctcaaagtttccttgatttctttcatgttgatttctaatcgtctcagtgaagcttctattttttcattatctcttcttagcatctggaaagctcgcctgtcttcgtctgcatcctgctgatcttcctgtgcccaggacgctccttggcttatgggtgaaacaggcatgcgttgctcaacctgaagtaacagcgagagctccttccagacatcactcagcttcctgttcacgtccttgaagagtattttgtcctggcttgctgttagaaacctgcagatattggatctattgctgaacttttctatctccccattagcctcctccagggcagccttgaagcggttcatggctgtggttaacttctcagagggcacgctcctctttccttggtcctggagcatctccagaggcttgatcaggccgaggacgcggtggcccaggcgccggcactgtttcttgcagtatttcatctcttcacaccgtttgtggatgacctggccaagggtgataatatgcttcaaattttccatgccttcgcgcctcccgaggggtgtgcgtccaatctgtcccgtgcacagttccaaaaagctcgctcttccaccttctttcccacgaccgcctcctgcccaggcgagaagtttgcaaacgcgaggcccgcgggagttcccctgcgccccctttcctggtgcccgcaccctgcactctgctgactgtaccggacgccacacgtggctggcggcgacaaggcgccccgatccctacctgagggaaaccccggccactgcagctgcacttgagcagggtccctccactcagccacttggatggctgtttctgtccagtgccctccggaggccactgcctcaggtctgtgatgcctgcagagaatggaattcgatatcaagcttatcgataccg

SEQ ID NO: 1985 - DNA, 1330 bp, Homo sapiens
tacacaagcctccacccagcttctaattgtctcactgagaacagacaaaactccagtagaatccttgaatgacagctaattgtctccagaaaaaatccaaaattgcctccctcccttaattgtagtgcagcatgattctgtttttctgctgggcccctatttgcttctttctgtgcaatgaatcattgaaagagtgaccaccacggacttggagaatctttgtagcttttagtctgtgtttgggtgtggctggagagacaaattaacacacagagccggaccttgaaggggaaggtcctcatttgtctcagattgggatcatttggggaatcagaaaatgtttatatcagaaaagaagagaagtcaatgtgtttcgcaggtttgtggttttttgaaggagaaacatctagattctagtcctgttcctctgcctccttcttaggtgatgttagmcaaaataattcacctytctgagtcaatttgcttatctgaaaaatagcawtaacaacagcactcattttactagggcatgtgaataamcagattttttcccattgagtggcaggtatttattgagtgcctactatgtgccaggcaccatcctactctctggggatacagcagtgamcaaamcagacgcacacctagtgatgagggatggagtaaagcccttagccgatgccagacagaggacatgagtcacctgtagtcgctgccactgctgctatttcatggctacattttgacccctgtggacccactgaaacctcctcactgcctcacaggcagaacaaggacagggtcttggccaccaagtttactcacttgagctgcatttagattattcttccagctaggccatgacagtaggtagtggcagctctctgtaaagatgaggggtccccagctcggacccctggtttcctccacctgcctggaccttacagtggtagccaggtgtgtcctgctgactgggaagctccttacctgggtgcttgaagtatggctccttagcatgtgtggagagaaggctattatgatagcaacctgcaggggtgggatgtgtaccagaccttcaccctggaactcccgaggaagtgcctgcagattgcctggcaggtcttattcgggtgatgtagagcagaacgctggggccaggttctgaagtcagacccctggactcaactcacgcacaactccttacctccaaactgtgkggccttggtcarsgraactgacttctctgagcttcattttcttcatcttaaaaaaaaaaaggagaatcacaccacctaccccatggagttgttatgaggcagagagatgtgat

SEQ ID NO: 1986 - DNA, 1470 bp, Homo sapiens
atatctccactcgcacgctgagttgtgcttcacacaagttttgcgcacggagtattccattaaatctactgaagcagtggggcaaggagaaaggagaggtgactgctgatgtttttaaagctctgacagtcacatatagattgtcccaggtacccctgctgcccccaagacactccaaaggcaaagatggatggtgacaaagtaaccttcatgcagaaacaagaacagtcacccccaacaacaagccctgctgaaggtgaagaatgccaccaggctgcctggcagttactgagtgcttattcctgctagcctattggagtcacgtcatatttgttacatggtaacttaattgtgccttccacgccttcacaaaatcagttgtacaagagaaggcacccaccacagtccatgtgacctttctcggtctgatttacatagtggggatgatgacactcgcgttgtagagtagttgcacgattaaacctggcacacagacataaagcactcaatgtctgacacatagtggactctcaagaagtttgtcatgcaggggacacttgaatgcccagtatgggccagacagcatcagctcatttcagtcccacagccctgtgagggaggaactctgccctgttttacagttagggaaattgaggcacaaaggctaagaagtcgatatccaagggcacagaatgattgggtgacggtgagcccaggcagtgtgacaacaaggttgctgccccacgccacctctgtctttcgtgggtatgtcggtgtgaggtgtaggcagccctgcactggcattcagcaggcgggactcccgggcaggctcttctgcgaacactcatgggccaccagccctttctggaacttgccttttttttttttttacctgaaagctacgtgaatcgttggtaaattggtgtaaraatggaactgagtcatctcaaaagttcctttcagttctaaaatyctgkgaattgaagcctactttttcactttaaatgatttattgggtttacagttctttacgctttctgattgaactgatttgaagttcttatttcgtgtgttggggaacacacccccaacccgtcacagcgtggccgtgggtgggagatrracgttaggctggccagtcactagggggcagcatcagcacgggtctggctgtccctggccttagggagcagtttctgcccctcctgccccgtcagaaagtctcggactcctctctgcttgcatgtgtaaagttttcattttcaggggccttttagtcaaaaaaaataaagctgtatgacttagtgctgaaggatatgaattaggcgtagctcttgggttggcagcataaaccaaggggcatcaacccaccaccgacaagctaagaatggtttttacatctttaaatggttgaaaaaaaaaaaaaaaaaggaattcgatatcaagcttatcgataccgtcgacctcgag

SEQ ID NO: 1987 - DNA, 1725 bp, Homo sapiens
ccttttttttctgttgttgttctacttctgggagacttcttcaactttgtattctaatatttctctgaatggaaaacaacttcatatatgattcacacaccacataattcacctatttaaagttcaatggtttttggtatattacattattagttttttaataattgtagtaaaacatataatacaaaacagttatcattctgaccacttttaagtgtaccattcagtggcaataacttagtgttgtgcaaccataaccacaaactatttccaaaactttttcattatcccaaacagaaactttaatcattaaacaataattatccatttctccactctgcaacctggcccctagcaacctctattccactttctgtccctatgaatttgccaattctatatacttcaaaaaagtataatcatacaatatctgtccttttcagtttggcttacttcacttatcataaggttttcaatgttcatttacatagcatgaataaggatgtcattcctttttatggtggaataatatcccattggatgaatataccactttttgggcttttgttatttttcattgacatatgataatcatgtggctggtgtctgcaatcccagcactttgggaatctcaggaggggggatcccttgagcccaggagtttgaaaccagcctgggcaacacagcaagatctcatctctacaagtaatttaaaaaattaggccaggtgcagtggctcacgcctgtaatcctagcactttgggaggcggaagcaggcagatgacctgatgtcaggagttaagagaccagcctggccaacatggtgaagccccgtctctactaaaaatacaaaaatcagctgggtgtggtggcgcacgcctgtaatcccagctactcaggaggctgaggcaggagaatcgctggaacctgggaggcagaggctgcagtgagctgagatcacaccactgcactccagcctcagcaacagtgccagatatctcaaaaaaaaaaaaaaaaaaaaaaaattaggcaggtgtggcacatgcctctagtctcaactactcaggagactgaggcaagagactcgcttgagctcaggaggttgagggtgtagtgagccatgatcgtgccactgcactctagcctgggtgacagaatgagagcccatcacacacaaaaaaaattgcacatatttatggagtacagtgtgatatttcgataacatggatacaacgtataacaatcaaatcagggtaattagcatattaatactctcaaggatttatcacttctttatggttgagaagactcaaaatccattcttccagctaatttgaaaatataaaatgaattgttaattatagtcagtctatagtactattgaacactagtaacttatccttcctatctaactataaacatatagatggtcaataggcatatgataaaatgctcaacataactataaacttcagggaaatgcaaatcaaattttaaaaaaatttttactgttggccaggcgtggtggctcatgcctgtaatcccagcactttggacagccgaggcgggcggatcatgaggtcaggagatcgagaccatcctggctaacccagtgaccccccgtctctactaaaaatacaaaaaaaaaaaaaagaaaaaaattaaaaaaaaaaaaaaaaaaaaaaaaaaaaaaaaaaaaaaaaaaaaaaaaaaaaaaaaaaaaaa

SEQ ID NO: 1988 - DNA, 903 bp, Homo sapiens
  misc_feature (302)..(302): n equals a,t,g, or c
tttagtcctgtgagtaaagctttggttttgatgactgtctcagggaaaggtagaaaggtgcttggtggcagtgaacttcctgctgcagaagtgggtgtgaccccagtgctggagaatgggctgtgagccgagtttcccgcacctgcatgagtgagcgccatggtccttctccacagagcgtcctgctgtcactttggtttgtgttaactttgacgcctttcttgtttcttactctgctttcctgcatggagcacacagccccggctccctttcagtctgcatggcagacacctggcctctrnaggtccagttcattctgtgtcccctttcggtcgtccctatgttccgtcaggtgattgagggtgaaggtcggccttggcagcccagtggaaagtcccttgactcctggccgtcagtggcagtctccagcctttgggargaggaaacttctatttaacaagraatggaattgactttgccacamacagccagagcgatgatttgtagagccaacctgctgagacattcaaagcatcagtcgtagggtcaggaccgccaggtgaggtgtggctccacctgcagcagcctggggcaggttgcctagcctctggctttagcatccccttctgtgaaatggggaaagtgatgggacctggatttgtagggtggttgtgaggacctacaggggtttttgcaaaatacttagcccagggctgactaaaagattcagagacgctgggcatggtggcacacacctgtagttccaggtactcgagaggccgaggcgggaggatcacttgagcccaggaattaaagtccagcctgggcaacatagtgagaccttatttcttaataaaaaaaaaaggaattcgatatcaagcttatcgataccgtcgacctcga

SEQ ID NO: 1989 - DNA, 1773 bp, Homo sapiens
cagagaaaggaaaaaattcttagcacagtacttattacaatctgatttcttttctttgtttttctgtcaccttttactaggatgtatgctccatgagagcagagcttcatggtcttgtttgcctctctgctgtctccacaatgactgcagcagtgtctggcacagagatgccaaacatttgctaaaggaatgagtagggaatcaggttctgttttgtcttacaccccccagtgcctaccactgtgcttggcccataacaagtgcccagaaactggtgggtactctgaggccactctgaatataattgctattggtagatctgtgttctcatcctagaatttagaatgggaaagcggtttagaactaagagtctttcaagtgtttcgagccaaactgcaaagcttttagaatattgtctctgcagcctgaaactgactattacacaggttcccccagttcccattcaagagcgaagtctagatgtttagaattctatgcctaaatagcagaacggaagcctcattttattttgattaaattcctattttaatacatacattgcatcagtcagtgagtcagtgagtatttattgagccccttcaggatacaaagtagtgctctggtagagctattgagtttgaaatattagtcacatttttaaaccaaaaccaaatccccaagtagttgaaagtgctgttcaaattgtcagagtgcagttcctgtagactgtattttgtgagatgggcttttactttatatgttcccacttgggcaggaacaaaagtttggtaaattactgaggtattacattttaccaaaatgaaattttgaagtgatccttcatcattagctttcttcctgtccaattgttgagggagtgtgtgataattacagcatcttttgagtaatttaagattttgggatcttgtgctgccaggacagggtaaagaataacacttgccttcactctttgacactagtgttcaaattgggcagggaaagaaggggtattattgttgcctcccagatcccaactctatccaaagtactgtctcctttacttctgtgagctgacagggttgcagaaacacataaaatcctagactatcttgacatcaccaaccgtagagtttgtgaaggtaacgtgtcctctacaaattctcatttgttttcattgtttgttactcttttttgttcagatttctctgttgacttctgcagtgaaccacctcaaagccaatgttaagtcagctgcagacttgattagcctgcctaccactgtagagggacttcagaaggtaggtgccatgtgtgggtacagagacttcagaaggtaggtgccatgtgtgggtactatttgccataattctagcttcttataagttttcattgaaagcctagcatttgaaatcagctgctccaagagggcagtaatggagtgtatcactgtgtcctaaagaattcagaacaattttgttttggtctggttagttaggcctttaatttgcaacaggttacctcagctgtgatttatatgggttcatacctttttatttggctctctgagtcccagaattgctctgctggcactcttgtgttagcatatatgggttcgcttttcagcttgctttttcagttcaccactcacaatatcttcatcaaagcagaccaattgtacatgatagttaccctaaatctctgttactttccataattaagaaagttaaaaaaaaggaattcgatatcaagcttatcgataccgtcgacctcgag

SEQ ID NO: 1990 - DNA, 2218 bp, Homo sapiens
ttttttttttttttttttaatacaactgaaccaacaaatttatttagttagtgctgataaagacagcagccttgagagacaagcagtaattacctggtctacttaatgatgccctttgttatattttacaggcaaaaagaatgattcctcagcagtcattgtgaaattttgtgggccacaagtattgtgcacacatgatccttgatttagagtcaacctgatgtccattatagctgtggaaaggcagcaggcagttgtgtcgctcttcacaataaggaacacatcttgctttcagcatgtgagaggaacaaaagcattgatgtaaatgtgcctcaaagtgagaactgaaaacattaacataaaataaaaaagtcaaataagactaagttcttacaactacctataaaaattgaattattacaactaaagcagcaaatcaaaacatctgctgaggttttctggtagaacaacaacaaaattagttggtgcccatgttcagtaagtcactaccattgacaaaactaaatccaaaataggaaattgaaaagtgcataatgaaattaaatcttgtatcaagtatttgtggaaaactggaaatgtttctctggtatggttggtgaatgatgatttggaggaggtattaaagtttatccgatccagctttggcctggtgttccacgtagaaaaggatgtaggccttcgccttcaccacagtctcctcgtcagtcagtgttacagtactgtcattgaagtggaaccagcggccttcgtgagttgcgtatgctgtgtaatgtccagaaccaaccccggaaccatggtgcaccaccacagcggcgaggtcatacaggcagctctccgggccactgttctcaggctctagtaagtagcatttcatgtctaggcctctcagtggaaattctacgtatgtatcaactttatttcttaaatatgctgtccaatgaaatcttttcaaatgtaagcatagcaccttgggtagtttttgaatccaaaacttttttgtggacttttgtttctttttgcatttatggcacatatataactctgtctcatcaagttcttctaagtcggtaaaactgcgaagacaatctcgtaacgaacaaactggtccattttcttgattcttagagcgcttacttctgaactgacttggaatatctaatgaaaggtctaggaatggatcaaactttctagattctgtcccacatatgaggcagttaacctcattttggagaatgcctccgaatatagccgtgacaacagtagatgctccatttatgcaacacttgttacttgcagacagagtagaattctcctgcagaattgctgagcgggaaacaccgttgaaaccgccctgaagttccaagtgtaggtggtccaaaaggtagcgcatgaattcatgggcgtcctgctgttgatagcccctaaagtttggcataatcttccaaacaacataaaataaggactctgggctaaatgcagtctggctgccttgccataaagcacagagtgtctttctaaactcttctaccaaagacacattgttatccccttggctcctggtgtggtatgtccgccttcctgctgttttcccattccttaactccacggcgggcagttctttgaaataacagcaaaactgctcaatgttactgagtgactgaaggatggcattcatgaaacatgtgttccccaaattccgaaggcctgtggcacaaatggcagtggtgctcccatttacttttaataacttgctgtttagtgttgagttttccaaaagttttcttttcttatgcctgtcagctgtgaaagctgagttttccaagttctgtaagtgttctctgactttctgtaccagtcccagcttggtgtcattaaccacaaaatcatcacagcgataacagtatgtactgtagctactgcaatccatacatactgtgtgctgaactttatcttgcttttctgatttcttatggttggttaaaggtacttgtgcatcttcataatgtttttttgcatggccattcacatacctctcaaaatctaggagaggaatctgtctcttcaactgcagaatttaagtgcttctacttttcttcttttttaaaaaaaagttatctgtacaaagtattttcaggttccccaaatccttccacagtggacacttgaacaagtcaaacagacccaagcggacgcgtgg

SEQ ID NO: 1991 - DNA, 1119 bp, Homo sapiens
  misc_feature (1075)..(1075): n equals a,t,g, or c
  misc_feature (1077)..(1077): n equals a,t,g, or c
  misc_feature (1094)..(1094): n equals a,t,g, or c
tcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggraaaatatatccctggtagttttgkgttaaccackgataactgtggaaagagctaggtctactgatatacaataaacatgtgtgcatcttgaacaatttgagaggggaggtggagttggaaatgtgggtgttcctgtttttttttttttttttttttttttagntntcctttttaatgagctnaccctttaacacaaaaaaagcaggg

SEQ ID NO: 1992 - DNA, 1955 bp, Homo sapiens
  misc_feature (1106)..(1106): n equals a,t,g, or c
gtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttaagggaagttactgtggtctgtaacttatgaaatncatwaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagmcaaatactctatgctyccatttatgtgaagtatctagagcagtcaaatgcatagaaacaagtagaatggtagttgccaaggmctgggggaggaggaaatgaggagttgtttaatgggtatagtgkttcagttttgcaagataaaaagtcctgtggattggttgcacagttaagttatgtgaatgctgtatgccaactcaactgtcactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactcaaaaaaaaaaaaaaaaaaaaaaaaaaaaaaaaaaaagggcggccgc

SEQ ID NO: 1993 - DNA, 1528 bp, Homo sapiens
aattcccgggtcgacccacgcgtccgcatgattacactaatgcattccagccttggcagcagatcaagaccctgtctcaaaaaaataaataaaaataaaataattgctgtgaaatttctattaacgtttttgggaaaaccagaggcttctgtgtgacatgtgaatcacagaggagaaatcatgaatctttatagccttgtgttaacatgacttccttttgttgatagagtggtttattagtctcaagacctttgaaatggcacatgaattgcttggacagattatggagacatccacccttctttagagatttaagtaagtagaaccagttagtgtgcctcttctgtttctcaccttgctcaatgcagaatgaacttggtgtatatccaccagaagcacctgcttatctactgtttgctgtcgttgcaggtatctgttgagattagctgtaacgagttgtatgtaattttataactaactgaattaagaaaagcctttgtaagattcagtatctgcttcaggtcattgaaatgtaaaattagaaagtaagctgagggcaggggatttttttctgttttattccatttattccctcaccacctttgccatccaccaccaacagtttcttttaaatttagcatccagagtagacctttgacaacgcaaatcagatcacttcatttgttcattaaaaaccttcaacaggtttcacattattcttaggattatatttaacatccttatacagtaatctccaagcctctccttgatctggtaccctctttccatctctaatctcttctttaacactcctatacttacttactcagccccaggcacattggcatatttgctgttgcctgaacatgcaaattccttgaacttgctgtttccttgcctgaaactctctttcctcagatatctgcctggccttcctcttaacctccaagtcttgtctcaaatatcattttttcagtgaggccttgcttggccagccctttccctcactatatcctgctccccaacaattgatttttacttatccatataacttttatccccctgtgtgctatatattttacttatttcttggttcattggctgtctccaccaaaatgtaagtgccatgaggacaggaattttattaatatcagtttgttcatttctatacctttagtgctttaaacagtatttagcacacagtaagcattcaattaaatatgtattggactgggcacagtggctcatgcctgtaatcccagcactttgagaggccgaggcaggtggatcacctgaggtcaggagttcaagaccagtctggccagcagggtgaaaccccatttctactaaagagaccaaaatcagccagtcatggtggcatgtgcctgtagtcccagctactcggtaggctgaggcaggaagatcgctagaatccaggaggcagaggttgcagtgagtcgagatcaggccattgcactccagcctgggtgacagagcaagactctgtcttcaaaaaaaaaaaaaaaaa

SEQ ID NO: 1994 - DNA, 2069 bp, Homo sapiens
ccacgcgtccgcctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1995 - DNA, 1528 bp, Homo sapiens
caggccaagaaatgatcataccccttgccaaaggtaaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgyggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagttttaaaaaaaaaaaaaaaaaaaaaaaaaaaaaaaaaaaaaaactcgag

SEQ ID NO: 1996 - DNA, 1751 bp, Homo sapiens
  misc_feature (1741)..(1742): n equals a,t,g, or c
aattcccgggtcgacccacgcgtccgacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttgggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttctttttttttttttttttctgtgtaacagggatttttaaataacggactatatgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannaaaaagggc

SEQ ID NO: 1997 - DNA, 752 bp, Homo sapiens
tcgacccacgcgtccgggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatgggctggcttaatacggacattgaggggatccttccccagaaaatccacctgtttgttgctggcaattttcctctcctcagctgcgtcatttcctttttgttgcttgccactactcaccactggggtctttggaagataatcttcctctttggaaatgaatggaaaagcaaaaggccctattacttttaaccactggcttcatataaacacttgccatttttttctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1998 - DNA, 629 bp, Homo sapiens
  misc_feature (2)..(2): n equals a,t,g, or c
  misc_feature (38)..(38): n equals a,t,g, or c
  misc_feature (41)..(41): n equals a,t,g, or c
tngaggtacgcctgcaggtaccggtccggaattcccgngtngacccacgcgtccgctcgaagttgtaatctctagggagacatttatagcatcttctttgacttcagcatgtgaaagagtaaggaaggatagtccaggccaaggaatcaacttttgcagggaagggaattttgtagggtagtcagaggccagtgtgtcattctctgtggttacagtgtactgtaggtggtgcgaggtgacataagcaaaagtgcctggagcttagtgggtgatgactaaatcagtattcttttcctttctttccctttccctaagcctcggctgatgcttctctgtcaaatcaggttcattgtcagcctgctgggttttttttttttttagtatatcgactatagttaagacttcaatttttccaattagtattttaaattatataataattaaattcatcctgttaaaaaattaacccttgtaaaaatgattattcttctctccagaatgaagtgctgttacatttttcttacatatccttcagaaagacttctgtatatataaatgtccatatgttttcttcttttcaaaataaatcatattataaattaaaaaaaaaaaaaaaaaagggcggccgc

SEQ ID NO: 1999 - DNA, 809 bp, Homo sapiens
  misc_feature (727)..(727): n equals a,t,g, or c
  misc_feature (738)..(738): n equals a,t,g, or c
cccacgcgtccggtggatcagcattttagaaactacaaatataggtttgattcaacacttaagtctcagactgtatttcttgcgggaagagggggactaaactcaacctaacacattaaatgtggaaggaaaatatttcatttagcttttttattaaaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcataatgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccaaaaaaaaaaaaaaaaaaaaaaaaaaaaaaaaaaaaaaaaaaaaaaaaaaaaaaaaaaaaaaaaaaaaaaaaaaaanaaaaaaaaaanaaaaaaaaaaaaaaaaaaaaaaaaaaaaaaaaaaaaaaaaaaaaaaaaaaaaaaaaaaaaaaaaaaaaaaa

SEQ ID NO: 2000 - DNA, 1208 bp, Homo sapiens
ccacgcgtccgccagctccaacccacagcaattacacttctccccctggtgaaggaaacacttgcataagaataagaggttcttccacaggcattttaaaaccttttttctttcctcttctccacaatatcagcatttaagtttaagcaagtttttttatttctagaagacattttactaggcaaggaatgataagaatccctgtgtatattctctattaagctttaattgtgaaaaaggatttgtagggctagtcttgggctgtggccaatctggtatgcttcctgtgtctgtatggtttgtgctgtaagcctccatctgttttacacatcctggggacatggcccacaactgcttgacagaactttgtttagcaatcctgctttaggggatcagccctctctggccaatatctgcatgttttcctactcctgtctcttaaagggccccacccagcgactggattttcttctgcctctctgtgtgggtactgtgtgtgatatctgtaaaaagtgcgctaattaatttggcctaaagaaagacaagaacttggatcaaattttttttaagggaagttaaaagctgtggtatctttcagttcacatgactttaatctctgagaaataaaaacagccctaaagactattggtaaaatgcaggtgagatgcaaggttttctaagtgttttgaggttaaaaactgctttttgggttttgagaactatttgacttgaaggcttcacaattggtaaggcctggggacatatggaaataaccacgctcttaattatgctgggagtcaaaccttggctgcacctagcacacaattaaacaacttaccaagtttttaccttaaaagttaaaaattgctaggagttactattccgagatgtaattgagactacaggaaatagatttatatgcaagatgtgtaagaacagtaaaatgtggtgtttttttgtaaaatattataagaaggcatggaaatgtatacttttgcttagggttaaaggattgtttaaattaggaaaaagctgaaggttcaaacaagtggtggagaattgtggaaattaatcttgcagaagaggttcaacatattaactaaattcaaaagggttataaggttataaaaggtttttgcttctttgaaatttctgagtcatccttttggcaaaataaataacttaatggcaaaaaaaaaaaaaaaagg

SEQ ID NO: 2001 - DNA, 2141 bp, Homo sapiens
  misc_feature (644)..(644): n equals a,t,g, or c
aaaaaaaaaaaaaaccccaaaaactgttactactaggttggagtagcctaaggcagtagggcaaggaggtgggcccaggctggtctgtggggagctggagaatggtgactcgagtgaccagtggacaggcaggacccaggccagcattacaagcggggatgtcaggcaggagcaggggagyttctcgcttggcagctggtttatggtacacttttgaaaagtaagctcccagggcctggccctcacatgctcagtgaatatttgactgaagggtcccctcatagcttgggagtattcacaggcctaaatgttagttatactattagctaagcctggtcctttgttacgaaatttaaaaatgaaattgcaacattcttgtggaaattcaaagacatcattttctttcaacaaattcacacattcrttcatgcttcttctataccttttacccctaaagtcatccactcctgagttcctcctgctggtttcccaaactgcgcaatgactgccccatcataggcagtggtccgtggagtcggcctcactttcgcctttccccgcatctacttgtttccaaggccagtggtacttaactgggtcaagttgcctgtgggaccttcagggaacagaattgccatgttccntcactgcctgcagggaaaggstccattccaagcccagtgaagatgtgtgcctatccagccgcccaccaaggatgtcatctgtagaatgggtggagggcaggggtttatttggtgtatatttttacattaaaatgcacttaatatcactttgtaaagcccagatgagtgcaaatgtgcctgtaacttcctcctttaatctgtccaggtagtatttagtctttagtcttacattttctttctccctttatttcatgaaattccttgagaaaacttcaacagtaaagaaagaaatttcgttcatctcacaactcttccaaacgaggaaacttagtgaaatatttcagagcttctagatgtgaggtacaaaacttgggatcaaatggaatcttgattcactaaccaatttaagatctgacttctaattttaggaactttgggttatgaacgcttccattttatacctgtgtctagttagtttctgcctatctatccaagaagcttttatcaagggtccaccatgtgccagccactgaagtagatataaatataaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtgtgcacaacaggatgtgtacagcagcactgttaaagtgtagcacatccatactacaggatcttatgcaactgttggaaagaatgaagcgatgctgcactgtggtcatgcagtgatctctaagacatattaactagaaagcmaaaggttwacaatgtatagcagctgggcgcagtgactcgcgcctgtaatcccagcactttkggargctgagtaggcggatcacctgaggtcaggagtttgagaccaacctggccaatgtggcgaaacgctgtctctactaaaactacaaaaattagctgggcgtggtggcgcgtgcctgtaatcccagctactcggcaggctkaggcaggagaatcgcttgaactggggaggtggaggttgcagtgagccgagatcacaccactgcattccagcctgggtgacagagggagactccgtctctaaaaaacaaccccccccccccaaaaaaaaaaatgcatagcaagctgtaatgctctttgtgttttagaatagtagaggtctggaaagttgtttgcttttccccagtttttttttgctgtgttacctctgaagggaattgaggtagaggggagagttagaaggaatattcggcttttctattttatatcctcctaggtgaaatttttacaacaaacatgtactggtgtattttgaaatgtttttaaatttttgtatttcaaaataataaaatataaattcaaactgaaaaaaaaaaaaaaaaaaagggcggccgc

SEQ ID NO: 2002 - DNA, 1118 bp, Homo sapiens
gggggctagaagtctggcacccaccgcctggccaggtgttcgggacgcgaccaggtgggcggtcgccccgccccgggagcgcggcttaatagctgagagcccgggggccaggccgcggctgcggccaggcaacgccctgagggtggccacgctgccaggtgttccactcccccgggactatgggcaagggcccggggcggggagggcggcaggtgctgacactggagctgcgccggagtcggggaactcggcctcctaagactgaggacactcgcctgctgggccggtcgagctgtgcggtgccctccgggacgcagggggcgctgcagccacgctgggtcaggctccgcaggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctaaaaaaaaaaaaaaaaaaaaaaaaaaaaaaaaaaaaaaaa

SEQ ID NO: 2003 - DNA, 1769 bp, Homo sapiens
gtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacaagtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcacttggggaggccgtggtgagaggatagcttaagcccaggagttcaagaccaacctggacaacatagcaagaccccatctcttaaaaaaaaaggaaagaaaacttgatgtgattgccataggtggaataatccaacataaattgccatagatagaaggtatctgtaatatatatatatatataaaatgaaatatatgtttcattttagagaaataactattactttagatctttccaaatctgagaaagggaggctagcatgtgttcaaggttagcacgcaacagaatttcctaaaatcagaagaattggaagatcctccccttttgaaatggccctgctgtgtcagtttccctgtggccttttgaactgtacatctcacatgttgggaaacgctggccactgggaaatcattagaaaggaggctgtagaatatttgccgagcctctactgtataccaggggctaactcaccaagcacattctaggaattgggccctgctcatgaggagccttagtggagattccaggtgaatatttatgaaaaagtcaacattagaactgaaaatggaaataaactgcttgaaaagacaaaaaaaaaaaaaaaaaaaaaaaaaaaa

SEQ ID NO: 2004 - DNA, 1149 bp, Homo sapiens
tcgacccacgcgtccgggtgacagagcaagactccgtctcaaaaaacaaacaaaaaaagattgaagtaatgaattttatttcagtggtatggggaaccttgtttctgacagtaggggaagctatcatgttcctggtaggaggttgcatcttatttcaagcggtgggaaaacaggacctggctttgcattagtaactgaagccaggtggtgaactctcagcatgtgtaaggagccggctgagaaggagctttgctcccatgatattaaattatctgattattgaaaacttttgtaaatggtcattagtgagcaaattgtctttttaaaaattctattatgaaagagttttaaacttaacagaaaataggcaagaacagtgccaagaactcctgtacactcctttgcccagagactattcctttagagcaaaggctacagcccagaatcacgcgcttcaccccattcatcacagctctcctttctgtccatctggtgccactcctcagttttcctgaacttccgcgattttggcgtttgtggaggttataggctgatcattttgtagaatgtctttcaatgtggattcgttgatgtttctgcatgattagaccccacctgtgtgtacttgaagcctgaatgtcacagactctgttctttttatcctattctgtgtctttctgtccagttactggtgaggttactgctgtcgccttgaagcacaaggtgttctgggtttgtcttgttttttcatgaccctgtaactggccacatcttcaaggagcgctgcttccatatagtggaggggggtgtttggaaatgagatctggttgctggtgtgcctatttccactagggtattgcagctcccagaccttctcataggatagagctaggggacttgtacatttatagttatttctgtatctgcgtcatatatcatgttcacacaaatgcatctaattccaatctaacatcacagagttgtcttttaaaaatatgacaagctggccatgcgtgatgctcacgcctgtcatcccagcactttgggaggccaaggcaggcggatcacctgaggttgggagtttaagaccagcctggccaacatggagaaacctcgtctctactaaaaaaaaaaaaaaagggcggccgc

SEQ ID NO: 2005 - DNA, 1281 bp, Homo sapiens
  misc_feature (29)..(29): n equals a,t,g, or c
  misc_feature (47)..(47): n equals a,t,g, or c
  misc_feature (83)..(83): n equals a,t,g, or c
  misc_feature (121)..(121): n equals a,t,g, or c
  misc_feature (133)..(133): n equals a,t,g, or c
  misc_feature (154)..(154): n equals a,t,g, or c
  misc_feature (1166)..(1166): n equals a,t,g, or c
  misc_feature (1262)..(1262): n equals a,t,g, or c
cacgacaggtttcccgactgaaaagcggncagtgagcgcaaccccanttaatgtgagttagctcactcattaggcaccccagnctttacactttatgcttcccggctcgtatgttgtgtgnaattgtgagcgnataccaatttcacacaggaancagctatgaccatgattacgccaagctctaatacgactcactatagggaaagctggtacgcctgcaggtaccggtccggaattcccgggtcgacccacgcgtccgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagtaaaaaaaaaaaaaaaaaaaaaaaaggggcggccgntctagaggatccaagcttacgtacgcgtgcatgcgacgtcatagctcttctatagtgtcacctaaattcaattcactggccgtgttttacaacgtngtgactgggaaaaccctgg

SEQ ID NO: 2006 - DNA, 1149 bp, Homo sapiens
  misc_feature (1138)..(1140): n equals a,t,g, or c
  misc_feature (1143)..(1143): n equals a,t,g, or c
cggggcaaccactatagggaaagctggtacgcctgcaggtaccggtccggaattcccgggtcgacccacgcgtccgccgcggggtctgtgctgagaataatggcccggttggcccgggacgagtggaatgattaatgatgttttgcagcagttttctacgtctgaaattttttatgtctctggaaccyagaatttgctaagagatggaggaacctcagaaaagctatgtgaacacaatggaccttgagagagatgaacctctcaaaagcaccggccctcagatttctgtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggtgaggagcaaagtcttctgacacaccgtggacattttagaaaacagctttcttgagatataatccaggccaggcgcggtggctcacacctggatcccagcactttgggaggccgaggcggatcgatcatttgaggtcaggagttccagaccagcctgaccaatatgatgraaccccatctctactaaaaatacaaaaaaaaaaaattggccaggcttggtagtgcacaccttgtaatcccatctattcgggaggctgagacaggagaatcacttgaacccaagaggtggaggttacaatgagccaagatcatgccactgcactccagcctaggcaacaaggcaagactccatctcaaaaagagagagagagagatgtaatctacataaaattcacacgtttgaagtgcacaatccatggtttttaatgtgttcacaaatagtgtgattatcaccacagctggttttagaacattttcatcaccctaaaagaaagcttttacccttcagtcaatcctcatttctccccaacccccagcccctggcaaacaccattctactttctgtctttatggatttgtctattctggacgtttgatataaatggattcatacaaaaaaaaaaaaaaagggcggccgctctagaggatccaagcttacgtacgggtgcatgaaccgaacnnntanccggac

SEQ ID NO: 2007 - DNA, 1869 bp, Homo sapiens
gcccacgcgtccggcctcagcctcccgagtagctgggactacaggcgtgagcaccatgcccggcctcaacgatattgattctttgggctgtagtcagtattggattatgatcaatattatcaccatttattttgttgctccagttcttccagctgtggccaatccttcagttggattcttgtgccccatcaacattctccatcctggctttttgttttgagcacttccttccttcctagcaccaccaggctcttgtattatccctgtccctgccctggaatcgactcctcctccagagagccctggtttcttttgttagaggatggtatatagaatccaacatgcagacacttggtgggacttattgttactggggttttgttatactagggtttcagtggtcagtgctagtatttatgtatgttaacccacgctgtgctttggattcaggctatttcaaattttagataatatggtacatatattattaataccactagttactacattggtacttttcaagcaaaatatatctaagtgggatcaaatgagactgtaaatagctttacatcagttcaggtcagttatgttgctaaattacttttggcattaagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaaatgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagatcctattccatgtcctttgaatatttatagaaattaaatggaacaaattagggcatcaggaaaactatacaaaagtctttaccaaaaaagggaaatatatatatatatgtgtagtactacctatatatatacataatatatagtactgcttatatatatatatgcctatatgtacacatatatatatacatgtataggcagtactatgttttctgatcataatatgttaaattagtaaaaaaaaa

SEQ ID NO: 2008 - DNA, 1867 bp, Homo sapiens
gcccacgcgtccggcctcagcctcccgagtagctgggactacaggcgtgagcaccatgcccggcctcaacgatattgattctttgggctgtagtcagtattggattatgatcaatattatcaccatttattttgttgctccagttcttccagctgtggccaatccttcagttggattcttgtgccccatcaacattctccatcctggctttttgttttgagcacttccttccttcctagcaccaccaggctcttgtattatccctgtccctgccctggaatcgactcctcctccagagagccctggtttcttttgttagaggatggtatatagaatccaacatgcagacacttggtggacttattgttactggggttttgttatactagggtttcagtggtcagtgctagtatttatgtatgttaacccacgctgtgctttggattcaggctatttcaaattttagataatatggtacatatattattaataccactagttactacattggtacttttcagcaaaatatatctaagtgggatcaaatgagactgtaaatagctttacatcagttcaggtcagttatgttgctaaattacttttggcattaagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaaatgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagatcctattccatgtcctttgaatatttatagaaattaaatggaacaaattagggcatcaggaaaactatacaaaagtctttaccaaaaaarggaaawatatatatatatgtgtagtactacctatatatatacataatatatagtactgcttatatatatatatgcctatatgtacacatatatatatacatgtataggcagtactatgttttctgatcataatatgttaaattagtaaaaaaaaa

SEQ ID NO: 2009 - DNA, 1156 bp, Homo sapiens
  misc_feature (11)..(11): n equals a,t,g, or c
  misc_feature (942)..(942): n equals a,t,g, or c
ctggaaaacgnctcactataggttaaagctggtacgcctgcaggtaccggtccggaattcccgggtcgacccacgcgtccggagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaattgcccagtctcaggtattctgttatagcaaaaaaaaaaagtggattgagatacttttttgctctgctacttacctctttwccagaatcttttaaggacttgatgtaggaactgagctatttagtragtcrttggtwgaagttwmcgcactgtactttgaaaattaagtgaaagcagaaaagtgagtgcgtatgtaaggaaaataatagtaaaagaacgctttgacttcttagcactcgccctctcctgtatatccccaggcaccttcagttgtctggaacaaagaatgtaggaaaaactgaagaaattcagaacagttaccaatgacaaaaatcnctgatcagaataaaaagacaaggttacagaatatacgttgytactgatcatttttcagaagcagaaggaaaagaatgccctccctggccattgagggtgataaaaagwaagccccactcctatcacaggcaatgaaggacagggatggaaaaaaaaagtgaagaagaaggggaaaaagcaaaagttatgaaaaaaaaaaaaaaagggcggccgc

SEQ ID NO: 2010 - DNA, 1472 bp, Homo sapiens
ggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtayacctggcccctctccgaagccccttgtccctttcttggggattgtggargctgggtcagargggarttaagggactgcaggcctggcagcargacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctac

SEQ ID NO: 2011 - DNA, 1991 bp, Homo sapiens
  misc_feature (231)..(231): n equals a,t,g, or c
ctctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaaganctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagaactgtggcttatcggctgcatttgggggcccgtgctctggcttatggtgagaakaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacrtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggctyataggtaacttgaaatgcttgctttttgttccctagttggtctaagggtctgtattggactaattctgaactacagacaaattggacctcaatgtcatttatttccctcatattaatgggagtgaaatgtctaatacttttgcccctttttatccagagttgtgggatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactaaaaaaaaaaaaaaaaaaaactcgtag

SEQ ID NO: 2012 - DNA, 1994 bp, Homo sapiens
  misc_feature (231)..(231): n equals a,t,g, or c
ctctgttctctggaatgccatgatccatccactgtgcaatatgactctgaaaggggtagtatggtaccagggggagtccaatataaattataacacggatctgtacaattgcacattccctgcactcatcgaagactggcgtgaaaccttccaccgtggttcccaggggcagacggagcgtttcttcccatttggacttgtccagttatcttcagatttgtctaagaaganctcagacgatggatttccccagatccgttggcatcaaacagcagacttcggctatgtccccaacccaaagatgcccaatactttcatggctgtagctatggatctctgtgatagagactcgccttttggcagcatccaccctcgagataaacagaactgtggcttatcggctgcatttgggggcccgtgctctggcttatggtgagaakaatttgacctttgaaggaccactgcctgagaagatagaactcttggctcacaaggggctgctcaatctcacatattaccagcaaatccaggtgcagaaaaaggacaacaagatatttgagatctcctgttgcagtgaccatcgatgcaagtggcttccagcttctatgaacaccgtctccacccagtccctgaccctggcgatcgattcttgtcatggcactgtggttgctctccgctatgcttggaccacrtggccttgtgaatataagcagtgtcccctataccaccccagtagtgccctgccagcccctcccttcattgctttcattacagaccagggtcctggacatcagagcaatgttgctaaatgactgtttcagtatgatcagaacttagatataaggatgggtccttcagattttagcatttaggagtttcaataataaccattgcttttaaaggaaattaatagaaagcctcattgaatggctttcagctagcacatggctgtttctatattctgatgagcccaggctyataggtaacttgaaatgcttgctttttgttccctagttggtctaagggtctgtattggactaattctgaactacagacaaattggacctcaatgtcatttatttccctcatattaatgggagtgaaatgtctaatacttttgcccctttttatccagagttgtgggatctcaggattggaagagattttaaaggccacataggccagctagtgttcatgtgttctttataaaatttctcccatccaagtactaaccaggcccgaccctgcttagcttccgagatcagatgagatcaggcgcgttcagggtgatatggccgtagacgtctttacaaaattcctgacaggtggttactgaatctctctatgaactttccattcaaaactttccaagtttttccttatgtggaaccgaaatctttctttctcccgtgaaactttactactatcagataattgaagacagatctctttgtattctcttcaagcccaaaccaattctgttccttcaatctaaatagtggtaatatgaatgtttaagaaatgaaataagaaacatgtgcaggcactttggaaggtgctaagtgactgccctaaggaatgaaaagcaagggccaggtgggagtagcccagcgaaggcacttgggctgccaggaacaggaggcgtgggaaactctggcttaggaaaacatgaacacaggggcaacagaggcaaactgttgttcgagttaaatataaatctcaggctctttaaaggtaaaaggtttaaggataatccatttggaagaagaaaagagtgaggctgaaagtaaagccacatgacaagcatataaaaaaaaatgcagatgatacaaatatgaaagaggccttcagtgtttgtttattaagaatcttaatgcagtttactgatggattaaaaacagctaacattgtctgaaaattatgttacctataagaagttggaaataaataaaagcataatcactaaaaaaaaaaaaaaaaaaaaaaaaaaaaaa

SEQ ID NO: 2013 - DNA, 712 bp, Homo sapiens
cccccgggctgcaggaattcggcacgagttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataattagacattttctatagatatttgacattctgcgaaagcaacaagcaaactgaagaccaactcctatgagaaatattatgatgtttatgtaataaagacatgtaactgtcttaaatttaaaaaaaaaaaaaaaaaaaaaaaactcga

SEQ ID NO: 2014 - DNA, 486 bp, Homo sapiens
gaattcggcacgagctccagagtgttcccatgatcaccacgtcctttgatcagtgccatctggaagagcagatgagtgcagccctcctctcatcctctctgtgctggctccgaacgcttgcttacagacccaccaacaaccaagaagctgcactggttggtacacactgcagcaaacaaggaaaacaagtatgataaaaagtccaacatcaaaaagaaaaaaaaaaccatagaaacaattgaagagagaatggctaaaggacatgaaaagacagttcatacaaagggaaattcaatgctgttctcgctgaggctggagtccaatgatgcgatctcagctcactgcaacttccgtctcctgggttcaggagaatggcgtgaacccgggaggcggagcttgcagtgagctgagattgcgccactgcactccagcctgggcgacagagcgagactccatctcaaaaaaaaaaaaaaaaaaaaactcgag

SEQ ID NO: 2015 - DNA, 654 bp, Homo sapiens
aaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaaaaaaaaa

SEQ ID NO: 2016 - DNA, 974 bp, Homo sapiens
ggcacgagccagggcgcacccgtcggcggtaaaagctgaggggctggcgcgggggattggtgggcgacacttttacgtctacacgtgcctacccgtctgcacgtttctgagtccgcacggttgtcttctcttgctgaatggacataggtgttttgttttgtcccaagagatacaggcaagcagtacaggggtgatggagtgctccttgaccttagcggggctgaccctggcactccctgtaggtctccccgctgcgaagactgagtctcttcactgcagtttctctccagttacccgccctgtctacggcccaaacggccatgctagtgaaaacctgccctggccgctaagcaagcctagcccaggctgtaacccatgtttctagggcttgttttcctctgcagtcaaatcagagattcggagttgaagggatcttagaggtcaacatgcccaacctcttagcccgagtgagtgaatgtacgctttttacctgcacaccccgaaaatcgcccgttttctggaaacaacgttgattatgtagtcctggaactttcctgcatgcacattttattccttcgacaatatttattgctacctactgtgtgcaggcattgtaggccccggggatacgattaaaaccaatgaagaacgaaacgcacaagattgttgatctcggccgggcgcggtggctcacgcctgtagtcccagcactttgggaggcggaggtgggtggattgcttgaggtcaggagttcgagaccagcctggccaacctagcgaaaccccacctctactaaaaatacaaaaattggccgggcttggtggcgtgcgcctgtagtcccagctactcgggaagctgaggcaggaaaatcacttgaacctgggaagtggaggttgtagtgagccaagattccgcctgcattctagcctgggcaacaaaatgagactctgtctcagaaaaaaaaaaaaaaaaaa

SEQ ID NO: 2017 - DNA, 472 bp, Homo sapiens
ggcacgaggcgagtgtcagtcggctctccgcacgtgtccgcggcctcgcggagcagtccacccctggctggtttctgcttccacctgctgatctcacagagcactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcgactttgaaaaaaaaaaaaaaaaaaaa

SEQ ID NO: 2018 - DNA, 924 bp, Homo sapiens
ggatttctatgcattgtgtaatattcagtgatgttgagattttgcatgttgttacaggtgctctttcatatgtgtgtttgtggtgttgatgtggaattgttaaccactgctgctatcacttattgtagttaaactgaaaaactgtgttaaaaggctgtgccagtcaacatttctatgtgtgacttaagtaactgtgtacttcattgtttaatattttgagccagcacttagtggcctctacagaaggaaatattgtagttgtcaaagtggtgccaaacttgaaaatcttgtgtcatgtttataattccaggccaggtcagcttttcttcaacactttccgagctctttgaaagcaaaaaacatttgcaaaaagagaaagaaagcaagaattctgaacttttctaatactctctcctctagaattttaaatatttttttcttttgatgtttgagtatcttacagaaaaatccaatcaaatgactagcggtagaatttcccttgatctggatatttttaggctgaacagtgtaatagcagaggactatgaggtgcatacattatttttgttggctatcatggcttattgtttgaatttcatttaataacaatattcaggctggaggtggtgactcacacctgcattcccagcactttgggagactgaggcgggcggatcacctgagatcaggagttcgaggccagcctggccaacatgacgaagcccagtctctactaaaaatactaaattagctgggtgtggtggctcacacctgtaatcccagctacttgggaggctgaggcaggagcattgcttgagcctgggaggtggaggttgtagtgatctgagatcacactactgcactccagcctgggtgagggagcaaggctccaacccccctaaaaaaaaaaaaaaaaaactcgag

SEQ ID NO: 2019 - DNA, 807 bp, Homo sapiens
tttttttttttttttttttttttttttttcacaaagattgacaaaactttaataaaagttaaatttacagacatcttaagataacttgggaaatatgtagtaaaaaagaatcgagtccacaaattaagaatattttgctaatatgcccaacaccaatttcagcaaatccaatctacttaactcatatatttaatgtggtaatttttctaacaaaatttaatgggggtatgaatgatatatttatgcccttgacaaagatgacatgtgtgattttgttgtgactaagaaaggagagtatgatttctggtggttatgatatcactctggctcatcgaagctcacagaatatgtaaggttctgccacgtccaaagatgttaggcaaatgtaatagaaggcgcaccgggctgacacacgttttcatcatacaaatcttctggcagttcctcttcatctccatcaggaaaatatgtagggaatggtagatttttaccgagatccttatatgcaggcagtttagaatctttgacctttactaagcaatttttatgtccaggtacagagccatttacatagattatgttgtgctttgtgtttattctccacactttcccatttttccaggcattttagttccaggccagactctgccaatatcaccagttgcaacagctccaggtctcctgtgggttttcgtttgaccatgcgtagcaggctggcctttaaatccccatcttttcatgacaccttgaaaacctttaccaatagttttggctgtgacatccacatactgtcctgtatctcgtgcc

SEQ ID NO: 2020 - DNA, 893 bp, Homo sapiens
  misc_feature (10)..(10): n equals a,t,g, or c
  misc_feature (18)..(18): n equals a,t,g, or c
  misc_feature (28)..(28): n equals a,t,g, or c
ggcacgaggnaaaagaancccgcttcanggttgccagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcgcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaat

SEQ ID NO: 2021 - DNA, 2037 bp, Homo sapiens
  misc_feature (22)..(22): n equals a,t,g, or c
  misc_feature (28)..(28): n equals a,t,g, or c
  misc_feature (68)..(68): n equals a,t,g, or c
  misc_feature (1974)..(1974): n equals a,t,g, or c
gttcccgggtcaagaatggccnaacctntttacccagaggagatytacggtaactgragtctgccctngaacacctytcatatttggcacccacggatacggraggtgggtttgcatgtccagggtgcaatcatggtgtccagcgtggtgraggtggtgattggcctgctggggctgcctggggccctgctcaactacattgggcctctcacagtcacccccactgtctccctcattggcctttctgtcttccaagctgctggcgaccgagctggctcccactggggcatctcagcttggtgagcaggcaccaggcctgatccctgcccagccccagcaccctaccctcttcatgtccttggtccttcttcccggctcctggccccagcctggcctcccatccacttcctgattgtgcctctgcccccagctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtcagtggggcctgcccacggtgactgcgctgctgtcctgggaatgttcagcgccactctgcaggcatcattgagtccatcggagattactacgcctgtgcccgcctggctggtgcaccacccccactttggtttagccccaccctgtctttgagaggcctcgcccccgcatcaagccccagccggtttatgcctcgctcttataacaggccccgcccctggaactaaccccgccccagcctcgtccccaggtctagcttccccgctggctccccggcaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactycagaaaatacagaaactgcatctgtgtgcaccaaggtctgaaaaatgacttycaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaaawaamaaraaatgagggcaggttccagggcctgaaatgtaggtatgctgcaaggcttttacattgaatttgaccctacatcacttcaagactaatgcataatattaaacatcatgttgaagaaataattttagtntcgtaatttatacatagcagtttctttggacaggatatattctcccttcccccaagggaaata

SEQ ID NO: 2022 - DNA, 1417 bp, Homo sapiens
  misc_feature (510)..(510): n equals a,t,g, or c
  misc_feature (696)..(696): n equals a,t,g, or c
  misc_feature (1363)..(1363): n equals a,t,g, or c
  misc_feature (1389)..(1389): n equals a,t,g, or c
  misc_feature (1394)..(1394): n equals a,t,g, or c
  misc_feature (1417)..(1417): n equals a,t,g, or c
gggcacgagcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaangttatgccaagctgattgctgaattggggcaagatttatctggaagtattactagtgatttaatcttagaaaatatcaaatctttaataggatgctttaatctgggatcccaataggagttttgggatgtcattttagaagtgtttgaatgcagaccagtaatgtactttctgtctctgtgatttngcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatycacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaaaaaaaaaaaaaaantcgagggggggcccggtacccaattngccgnatagggagtcgtattactttcan

SEQ ID NO: 2023 - DNA, 1837 bp, Homo sapiens
  misc_feature (1697)..(1697): n equals a,t,g, or c
aattgccatatacttctcacccagtttctcctaatgttaatattttatataaccatggcacatttatcaaaactagaagtgaatattagtaatgttactattaactatgggctttattcagattttaccagtttttctgctagtgtactttttctattccagggtccaatctaaaatcccacattgcatttagtttgtgtgtattttctttctttattattattttttttttggtaattaagttttttaaaaaggtcatagactatagggatttcatttacaagaataatatcttcagcatatggccctttcctgatatgtctgactaatgggtttctaaaatgtatttgcagagattgccttgcaacaggtttccatgttcttccgatcagaaccaaagtgggaggtggtggaacctttgaaagacataggtgagacattggcacgctcattctgttaaaaagacagatcacagaactggatccttagtcatgctttctgatacgtatcccaggaacatgcttaaatgcaggtgacttctttttctttttgcatatcaactgcttgaggatacagctggtaacttttaatacttaatgaaccttggttaaagccccatcaaagcatttggatggtaataactttcagaaacaccattccttcttcatctatctttttcactaaatctaaactgaagtgctactttcctgccttttccgtgaataatttcttcatttactgtttctttttaagtatagcctttactatgccaacgttatcaaatggttcttttacttgtgcctatgtagctgcgaataatattgccaaacttaatttttcttgattacctagtcagtgaaacatatcagttgttgcaaaaattgtgcagctctaagcacatttttgcttttatggcaggttggagaataaggaagaaatatttcttgatgaagattaaaaatcagccaaaggaacggctagtgttaagctgggctgaccttggcccagacaagtattgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttanaagaggcattgagaattgccaaagaatgtatagagaagagactaattgaggaacagaaacagattcaccagcatcgaagactgacaagagctcagtcccaccatggatctgaggaggaaagaaaaaaaaaaaaaaaaaaa

SEQ ID NO: 2024 - DNA, 493 bp, Homo sapiens
ggcacgagctgaccccttttcctcatctgtctaatcccccaacttagggaaataaatggttcctggcctcttgatctcagttcagactgcaaactcttaggggcaggggtagctacatatcaggctatgggtttggtgctagaatggtgttgatactgtggtgttctctgaggatggggatcccagccaatgccatctggcatagtgctgtacacaggtgagtttgtttaggaagatttggggaagatgcctggagtctttggaatggcaactcctgctgatggagtaatctatctgtctctctttccaggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccaaaaaaaaaaaaaaaaaaaaaaaaa

SEQ ID NO: 2025 - DNA, 460 bp, Homo sapiens
ggcacgagccagccttcagtccctggggcccggagggctggccaggggcttgcggggcactgggagccactcacttgaggtggtccagcatcatgcagctggccagcagggtggccgtggggttggcgatgttcttattggcgatactcttgccggtgttcctcgtagcctggggaggcaagacgaaggagagtgggtggagggcagaaggatgccgggcagtgactctgctcctgtgacacgtccagaagaagccactccacagggacaaaagcccaccagcgggtgccaggggttgggggaaggtgtggggacagatagcttatggggacaggctttcctcgtggggtggtgaaaatgttctggaatgacctggtggtgacggcagtacaaccctggatatccaaaaaactactaaatcatgcattttgaacgggctaaaaaaaaaaaaaaaaaaaaa

SEQ ID NO: 2026 - DNA, 1369 bp, Homo sapiens
ggcacgaggttttttgtaacaaagtagccatcattatagaatattaataaatggattattaatatgattgtttcaaaaggacttgatataaaaattaagggtaaataacttggaagaaaattttgttttaaattatagcagtagcttatatatccaaatatctattggttgagccatccaatagatgagtgacgcttagctgttttatgtaaatggctttcctaacaatgagaatactcttttttgcttattcatttagtaaaaaacattttttaatggaaatatctgagcatggtcattaacgtggccactgcaacacatattggtggaagtataaattaatccagtgtttctacaaggcaatgtgacagtatcatgctttaattcagtcatttcatttctaggaattatcctaaggaaatagttataaaagacacacaatgatttatgggcatggctttgcatttcagtgacatttgtaataataaaaagttagaaacaaacgaaataggttaaaaaattatggtatgcccaaatgaagacatattctcctatcagtggtaattaatactttttaaaaattgtccaaactttttgcaatgaaaattcctgcttttatacccaagaagtatgtattttttttttactcgggaggctgaggcaggagaatggcgtgaacctgggaggtggagcttgcagtgagccgagatcgtgccactgcactccagcctgggcgaaagagcaagactccatctcaaaaaagaaagaataaaaagaaatatgtatttttttcaaaagcactactgaaacttactaaatcaaccctcaacaagtcatcaactttgaatattttaatgaattgcccacaacaggcttgcaaatagtttctagccaggttaggctataataatgttaattaagacgatttgtttagcctggcttagtggcatgcacctgtagtcctagctactcaggaggctgaggcaagaaaaaaaaatttgctggctgcacttgtatttgattatgttctttcttgactaccgattctaacatcaaaacagatgcaaccagctgggcacagtggctcacacctgtaatcccagcactttgggaagctaaggcaggtggatcacctgaggtcaggagtttgaaaccagcctggctaacttggtgaaaccccatctctactaaaaatacaaaaattagtcaggcgtggtggcaggcgcctgtaatttcagctacttaggaggctgaggcaggagaatcacttgaacctgggagggaaggttgcagtaagccgagatcgcgtcactgccctccagcctaggcaacaagagcaacactccatctcaaaaaaaaaaaaaaaaaa

SEQ ID NO: 2027 - DNA, 1556 bp, Homo sapiens
ggcacgagtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagcccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaaaaaaaaaaaaaaaaaaaaaaaaaaaaaaaaaaaaaaaaaaaaaa

SEQ ID NO: 2028 - DNA, 1259 bp, Homo sapiens
aggattcggccgagctttcttgtaatttgtcatttgtatatctctcctgtgaattgcctatatatatttcatggccattttctcattaggatttctttttttcttaccagtttctagaaatgcattgtttattcctcttcccaacttggcatcaagtgtatcttatgtttttctttctcataaattagaatgtttcattttcagttatattaattttccttttttcttaagtacattaaaaaaggtacaacagtgaaattctcatttgtatttgtcactctgtttcttattggatgagtaatcaggatttttggggaaataactggatatttcatacagcaagcaaataattcaaagcatgggaagttaacatagaggtggtagtggggatgcataaaatcgtagtcagtaagttaacaatgagggaaataattaaatttcactcagygtttacaaacattggaaaacattctgacctgatgggtctgatttcttttgttggaattgttttgtctgtttaaggataatgtgaattactgtgtgtgtagtataattagaatataccacagtatcttaaaattgtttagcatatactttaatcagttggatctgcttcaccctcttctccccatgaagaaaattatatgttaagtgctcataccatatctacttatcttcagtaactatatttagccttagcattacaccagccttacagccttattcattcatttagtttctaaacattaaaatcttaaatactttttgtttaaattagttattattttgtttttatttttttttaatttcattttttctttttatcttcttggttaccaagttttagtgagttaagtggctgtcagagtattggaagggggtctgtttgaggatgaatggtaggaattttacatttgatgttgtcttattttaatgagtcaatacagaaagtacttcagagtatttatgaaaagtgtaaatctaatgttacatgagaatgtggctaggactttatggttttaaatttctccattctaaaattatgaagatcaatttatatgtaaatcttaccattaagaacatgcttattgataaatctaaatctctattttagagcaatatactttgctgcttattcaaactgcaaggaaaagttgaatgatgtatttgatcctgattctacccaagtacatatgatttcagctgcaatggcaggtatgaatgtataatattaaaaaaaaaaaaaaaaaaaactcgag

SEQ ID NO: 2029 - DNA, 1217 bp, Homo sapiens
ggcacgaggggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagatacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaataaaaaaaaataaaaaaaaaaaaaaaaaaaa

SEQ ID NO: 2030 - DNA, 1876 bp, Homo sapiens
gcgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggaccgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaacctgaaataaataaatgttagattgaaaaaaaaaaaaaaaaaactcgagggggggcccggwmccaattcgccctatagtgagtcgtacac

SEQ ID NO: 2031 - DNA, 1876 bp, Homo sapiens
gcgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggaccgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaacctgaaataaataaatgttagattgaaaaaaaaaaaaaaaaaactcgagggggggcccggwmccaattcgccckatagtgagtcgtacac

SEQ ID NO: 2032 - DNA, 1133 bp, Homo sapiens
  misc_feature (38)..(38): n equals a,t,g, or c
caatccccccgaawaawagaaactgggaaakgataaanccccctaatgcccaagggtccwagtgtgwtccytagtggttawactgggaagtgtgtggagaatttaaggtgcctgctctgctgctcyggatggctgaaggctccygggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcaaaaaaaaaaaaaaaaaaaaaaaaaaaaa

SEQ ID NO: 2033 - DNA, 1609 bp, Homo sapiens
aattcggcacgagcggcacgagcagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtgtcatcaataaaattgtatgttaatgctggaaagaaaaaaaaaaaaaaaaaaaac

SEQ ID NO: 2034 - DNA, 1359 bp, Homo sapiens
  misc_feature (808)..(808): n equals a,t,g, or c
ggcacgagccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcaggggacccagagggaggccagcagctgctgcgggactctggagcgtgagaaccagcgcctggaggctgtcctggcgtggcggcgctctgagctggtcttctggcggtggatggacacggtcctgggcacctgtgccccggaggtgcctgctgcagcctcacagcccacccccctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccanccccatgggccacaccggctggtgagacgaaaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccaaaaaaaaaaaaaaaaaaaaaaaaaaaaaaaaaaaaaaaaaaaaaaaaaaaaaaaaaa

SEQ ID NO: 2035 - DNA, 1490 bp, Homo sapiens
ggcacgagtggactcgagcaaagatgacctcactggagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatgggctgggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaaaaaaaaaaaaaaaaaa

SEQ ID NO: 2036 - DNA, 522 bp, Homo sapiens
aaaatataaaaataaaatgcacgtcttccattcttccccactgcctgtgtatagtggaggttggtgctcactcttggtccttctgagcttagcagaaagaactatgggcagttctacctgaaaagggagaactcacatgggcaggaaagagcattgtggcaacaaaggagaggtcctcactctgctcggctctaggaagccacagggggcttgatatcagctcagtctacaagaagtctttccttccactgcttgtggttgatttttaatttttaatgtaaaagcatattgcttgagccagggaatttgagaccagcctgggcaacatggtgagactcagtctccacaaaaaatacacaaaattagccgggcgtgttggcatctgcctgtagtcccaactacttaagggcctgaggtgggaggatcgcttgagccccaggaggtcgaggcagctgtgagctgagctgagatcacaccactgcactccagcctgggagtgcaaaaaaaaaaaaaaaaaaaaaa

SEQ ID NO: 2037 - DNA, 930 bp, Homo sapiens
ggcacgagctctatctgggatagagttaatgagggctgcaaaaatagcatcttcatggaaaaacagggacaaatttgtggatgcaagattccagcccttagaagttcttggcatagtaaatgtttaacttaataaattttctatgccttagtaatggaatttcctgctttttgggaaatatatgcatttattatttctgctcctgtgtttcacatgcaaataatacagaaaggagcaagatggacaaagatcttgctgtcctacaatttacatctaatgggaggagacatcccacatataacctaagttttaaaaacaaatgatgaattttaaatgattttaattgtttgcgattgcactgctttttggtgcacccgtctagattcaatattgcattttatgtgttcatttgtttcgatcagacaggcattttgaggagtaaatgtatgtggttgtgtataaggtattgtcacagaatttcccttctctttaaaattattcttttgaggggaattttgcattcgtgctaactgactggcatgtacagatcgggagccttttctattttctctgattgctttagattttctgtatcaaaacttgaacagatcttgagcagcgtttagtacttttatgtacaacctactggtcttgagagtctctgatggtgaaattggactaagttagattatgtaaatctagagccctttgagttagtctatcttttctttttcagacttcacagcagcaaatgtttatcacctcttgaaaagaagcattagtgcttcaattaatccagaagatagtactttccctggtaagtataataaactcctcttttctctggcacagcatttgtactggaaattaacttaattaatttggaccctaaggagtacaaggaaatacttcaaaaaaaaaaaaaaaaaa

SEQ ID NO: 2038 - DNA, 580 bp, Homo sapiens
ggcacgagagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaaaaaaaaa

SEQ ID NO: 2039 - DNA, 1224 bp, Homo sapiens
ggcacgaggcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagtccaaagtacagtttcagcaaagctgtttgaaactctccattccatttctataccccacaagttttcactgaatgagcatggcagtgccactcaagaaaatgaatctccaaagtatcttcaaagaataaatactaatggcagaaaaaaaaaaaaaaaaaaaaaaaa

SEQ ID NO: 2040 - DNA, 1448 bp, Homo sapiens
gaattcggcacgagttcagtaagaataatgtttttggctttcacatatactcagtttaagtgcttagtattaataacaagccatgaagggaataaattcctcttcactgagacatagacttkggaataaaagacattttaactgatgtgcacaattattaatctagtggataagatggatttaaaaggaagaacaaaatgttcccagtactttttactgtctgtggttttattactatctatgggcatagtgggaagcatcattgagactttagggaaactataaaagttggaagggtggtggcatcaggggttggatgctggttctcaagttcctagctctgccccttgttagtcatttgagttaaataattaatgggaatatctacttcacaggattatgaggaatcctaaggggtgtaatccatatcaaacttttagaaaccagttgttttattacctgggaaaggtaakraagggccagactttttatactactgttagtatttaaatttgggatagtctggatgccacctaatacagttactatgaaattaacaaggtaactaaggaagttgatagtaccagtattatctattgctatgtcctaaattaccatagatttagtggcttaaaacaaatgcgtctcagtttctgtctgarcatggtttarataggtcctttagaaagctcatggtctcatctgcattctcacctggtgatttgggaagaactcatttcagcctcactcggctggcagaattcagttcttgccactgcaggactgartgtccagacctctcactggttgtcagytggaggcccccgcttagttccttgccagctgggtgctccctgcatggcctggctgctgactggaccactgacatgattactgtcactaccagcaagtgtcgagagccaagctgccagcaagaggggtcttttcaggtcctgcccatatccaaggggagaggctcatacgaaggattggataccaagargtgcgggtggggctaatgggaaggcacctaragtttgtcacagctttttttttttaactgaatctctttaaattggtcgtctcsccctacaatgcaaatgctttgtgtacaagtaaaaagaaaaatggctctcacaatatgaaaaaccctggctgggcactgtggcttatataaacctgtaatcccagcactttgggargcccargcgggtggatcccttgaggtcaggagttcaagtccaaccaggccaacatggtgaaacaccgtctttactaaaaataaaaaaattagccaggcatggtggcatgcgcctgtgktcccagccactcgagagattgaggcaggagaattgcttgaacctgggaggtagaggttgcagtgagctgagttgggccactgcactccagtctgggtgacagagtaagactccacctccaaaaaaaaa

SEQ ID NO: 2041 - DNA, 1143 bp, Homo sapiens
ggcacgaggacgcgaggcagggagcttccaggttatagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagactccgtctcaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaaaaaaaaaaaaaaaaaaaaaaaaaaaaaaaaaaaaaaaaaa

SEQ ID NO: 2042 - DNA, 1589 bp, Homo sapiens
ggcacgagaagaccttgtattttatagacccgttatactagtattgttatcttacttgatgaaatctcttaggcctcctaaatttccatcattaaattaaaaactgggattacaggcgtgaaccaccgcgcccggccgacagtgatttttcataaaggtgttccctttgttctgggatttttagccttcatacatttttactgttaggcatttcctttttcagatgatggtgataatagttaaaaaaattttattgatagtattaagggagtccactaccttgtgtcagattccctgtttctttttgaagcccttgaaatgaagtttagggaccactgatctagaattctctttatgctcctccactacccattaaccccactctatagtctgccttttcgctttcttctctcctcccttctaamcacttcgtagamcactgtgttttctgttcatgattgaccttcaaattgccaaatcctttggycttataamccgtmtgtacttaaccaacactctgttgttaacaaatccttcaaaactgttttcttttgcttccgctctgtttttcctgtcatccacttatcacttttcttcatatgttttctttcttttgttcccagttgttattatgtggggttctggttctattttatgttctcactgtatattcagaatcagatttttagctaccatgtaccatcttaataatacctagcatttatttactctttcctaattgttatttcagtgcttcagtatttcagtattcatttaattcattcagtattcatttaattctcaaaacaactcagtgaggttgatacaggtataattggtgtcttttttttcttttttctgacactggcatatcgaggcccaaaggttaagtaatctgtgcaactaggaggcagtagaactgggatttaaacttagactgcctgtagaggccatgttcttaaccactactagatttttggcgtccagatgtcccttgtatttctaacttccgtttagttwttctacctccaattcaatacatccattcagttaatctcaagtgcctgcctctttcccttgcaaaacacacttgctcattctttattccttgccacattaaagktaacactatcctccccatcgctagkactatagaggycattgaaccytccccctgcgtatggcctgtgagttttattgattccagcatgattatttggtgatatttgagtgcgattttgtgctagatcctgggtgtataatgatgtatgagacacagactttgtcctcagggagcttatactctagaaataatttttttttttcaagagagcgtcctactctgttgccgaggctggagtgcagtggtgccaacatggcttactgtagcctcaggctcccgagctcaactgatcctcctgctgcagcctcccgagtaggtgggactacagacatggactatcacaccaagctgtttttatttttagttcaggtgggttctcagtttgttgcccaggagttggagaccagcctgggcaacagtgagaccctgtatctaaaaaagaaaaaaaaaaaaaaaaaaactcgag

SEQ ID NO: 2043 - DNA, 831 bp, Homo sapiens
  misc_feature (53)..(53): n equals a,t,g, or c
ggggaaccaaaagcttggaggttccaaccgggggtggcggccggttctagaantagtggatccccccggggttgcaggaattcggcacrrtgagggtgagcaagaagaagactggaaatgccatccctctgtcaccaatccacagtgggtttggggaggaggcatggccaacatccactgggctgcacagacagttttattactaccccacctggctcctgccttctggggccctgcagcccatgaattaatccctttccaggctagcctggggtacatccatcccctttggctcctaacccatggagtcaagcctcgggcacatttctcctaccagcctggtttgggccatatctatgtaatgcttttgccttcatttacttaggttgctcccttaaacaggctcacattttaaacataacctctgcctcctaagcaaatacttatattcataaattactcccacctgaaccaccaccactgccaccacccacaggattcctgggcttccttgcagcatagataaaagcttttttgggcatccacttaccaggcactgggtgggagcaggcagcagggcacatcctccctccttggaagcaatatttactcagcaattctccactcagcagtgtaaatcactgtggcttcccagcaggcatatgatctctgcctggtcgggtttctctcccttttccatgactgaatctgaagctcaagcccctttccccacagcctctcccacatatgcctggaaactgaggtctggctcatccttcagggagctccatgcttccctggtaaggtaaaaaaaaaaaaaaaaaactcgag

SEQ ID NO: 2044 - DNA, 784 bp, Homo sapiens
ggcacagcagaagtattaacttgttcaaatcgtacaaccaaggctcaagtccatgattgcccaactccaaagcccatgttctttctaccttattatgttggcattgttttcaatgtcagtttggacccatataaaaacgcccagctgtaccctatgaggaggatataaaaatgtgagatggtagttgacactcggaggacattcatatctccaaacccaaccttatgaagttggccacagcaagcatgttggaaactagaaccaggggtttcatatcaagccatttgcttaggtctgtatctcaaaagctttaaatacaactttttttggtgccctcttgataaggagtcttatactgagctcttcttcyctttwatagctggtccaycrgaaagattaaattaaacgtttggccacatggacagttaatccttagatcacccagttggatggttcattcctgctatgtttggtttgatttttyatttttggaaaacaaatagtgagtcagtctgctttccctccctttctctgcctcaccactccttctggattctcttagatgctctggtcatactaggtaaacagtatttttcttaaaattttccttgagccatgacagaatcatgagagagctcccctggctctgatacttaatgcccccctctaaaaagaaaggtctatttgaggctattcacttttgtcatcttgaaagagtctctgagtcttacctagcaggaatattttgtttcttttcctaaaaaaaaaaaaaaaaaaactcgag

SEQ ID NO: 2045 - DNA, 1178 bp, Homo sapiens
ggcacgagcggtggattcctgagcattcaatacacatgaggactcccaagttcaaactggcccacttaggattctgggtctcacagtccacacagtgggcgttcccacgcatgttttggatcgactgcagggccatggcctcgctctggctggtcagctgggacttgcttttactgctctcgcatgactgcaggctggccaggatctggctctggatggcttggacccaggcatcccgctcctcatacgtcgtggcttcaaagtgccatgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagagctggagatgggtgcacaggccgatgtggctagggatggccactttcctgggactttgatggtagatgtccgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttctgttcttcgtaatgtgcacggtggaaacctgtgtggaacagaaggaggaatggcttcaaaaattgggtagtggcttgcagggtcctatagacagcttacaattaccttttaaaaagatacattttctgggccaggcatggtggctcacacctgtaatcacagcactttgggaggccaaggtgggtggatcacgaggtcaggagttcaagaccatcctggccaacatggtgaaaccctgtctttacaaaaaaaaaaaaaaaaaa

SEQ ID NO: 2046 - DNA, 1579 bp, Homo sapiens
tgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttgcgagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaaaaaaaaaaaaaaactcgag

SEQ ID NO: 2047 - DNA, 954 bp, Homo sapiens
caggaattcggcacgagaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaaaaactcg

SEQ ID NO: 2048 - DNA, 1563 bp, Homo sapiens
ggcacgagaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaaagacagtatgtttcagagaacattgggatatcagttttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataaaaaaaaaaaaaaaaaa

SEQ ID NO: 2049 - DNA, 1847 bp, Homo sapiens
cccacgcgtccgcaggatggagtgcagtggcacggtctcggctcactgtaatctccacctctcaggttcaagtgattctgctgcttcagccgcacgagtagctgagattactggcatgtgccaccatacccagctaagctcttttctattaaattttttttctgagttttcaactcttttggttttaactgccatttctatgttctgtttctctctggtaacctacgcctagacctcctggaaaacagtaaatgggccacacaagcaatactactactgtgatatactgaaaacctgtatgcagccatttagcacacttgaacatacaattttactcytattttctatttgtccattttcattctcaactaagttggaagctgcctagggataggagcgatgtataattcccctcactgagtcccagcccaatgctgacctcatactaggtattcaatagggtactacaaacaagatttgtcatccagcaagcatgggaaatgttttaaaaacatgataccctcactcttacaaaagccttcaaaattaccagaagataatattgttactgccaaaaagcaattcatgtttacttagagcttactaaatgtcaaactttgagctctaccctttacagagagtctcccatttaatcctcacagcaaccccatgaggtttggagaggctaaataactcactcacatagttacagtcaagtggcgtagctgattcagtctacactcgatcagcccatgaattcaaaaatttaagatcccccaaatatttcttaacagtataggtaagaagtatagtgatttgaaagaactgatttaaagtaactcctcacctctcagcccttacctatgcagtttcccttgtaggaacaccaccttcgtcccacctctctactggcaaattgctacacatccttaaagtcacggcaagcactccccaactcccctcagcagcactcccactgcacctggcactcactgccattctatctacctcctgctctagtccatgtgtctgtttattatttaccaggagaatctgagctccatggggttgagaaccttgccttttcacctccattcccaggtttctagcacagtacctaccacacacacaagtgtacagtaaatatctgttcttgaaatcattattgtggtagcattaagagacttagtttgcaacatctatctttcacagcagatctgtatcacaatctacaccataactttcaacaattcatatttgtttccatagcaactagggaaagtgctccttataatactaggaaaggcaagctctaccttaaggttcaacccactgaaatacttcacaatcacttgctttttgttcttagtgtgaagagacagaatgacagcattttaactttacgtctttaagaacaccttaactttaataatgacagtaaagcttattttttcataagtactagagttttcattgacaaaaggacagcatcttattaattcacaaatctaaaatacccttaagagtccaggtgctgtggctcacacctgtaatcccagcactttgggaggctgaggtgagaggatcacttaaggccaggagtttgagaccagcctgggcaacacagtgagaccctatctttacaaaaaattttaaaaattagctgggtacggtagcacgtgcctatagttccagctactcgggaggctgaggcaggaggattacttgagcacaggagtttaaggctgcagtgagccatggttatgccaccgcactgatgcctgggcaacagagcgagactctgtctcaaaaaaaaaaaaaaaaaaaaaaaaaaaaaaaaaaaaaaa

SEQ ID NO: 2050 - DNA, 1391 bp, Homo sapiens
  misc_feature (782)..(782): n equals a,t,g, or c
  misc_feature (788)..(789): n equals a,t,g, or c
  misc_feature (791)..(791): n equals a,t,g, or c
  misc_feature (1019)..(1019): n equals a,t,g, or c
  misc_feature (1021)..(1021): n equals a,t,g, or c
ggtcgacccacgcgtccgcccacgcgtccggtatgacataaattttccttccttttactttcagccttcaaatatttgaattcagtttcttgttgacatttgggtcatgtttgttgctgtwtttttgttttgctttgttttttgtaaatttcactctgccatctctgtttttaattagtatatttagagtgcttatatttaatgtaattattgatatcttagggtttatatttgccattttatttttcttttctttttttacctctgtttcttatttctctttttataatcctgctttcctgtggattacttgaatatacttttaaattccattataatttatctatagtgttttatatgtatttctttgtaggckttttttagtagttgttcttcatattacattatagataacttattgccatctattggcatctgatcataccattgtctgtgaagtgaaaaacacttaccttctkgcagattcttttggtcttttttatttagaagataattatcttaaatatttcatctttatatatktagttatataatctttgcttcaaccattaggtatgatttagaaatctcaaaagaagaagaaacctactgtgtkccccatagttaaactcactctgatcttcttttcttcctgatcttccgagatatcctcttttattgtkttctttctgtttagagatgtttctttaactgttctcttaggataagtgttttggttacaaatctcagaactcttagggtttttgtttctttcttttttntttttnntnagttttgttttaaacgtgaagatttcttgatttccccttcattcttaaaggatattttcatgatagaattctgaatgggactgcccccctgcctacttttttttttttgctatacttgaacaatattatgccacttatcctggaactcmcagatttttatgagaaatctactctcatttgaattcccatttttctatcattgcctctaagatttttttaatccaatananaatacaaagttttagcaaaaacatggtaaattccagcaagaaatagaagatacaaatttgtttttattaggagttattatatatttatggcatgttcatcctgactagggaaatcgcaaatcctcctttaatatccatcagccatcaaaattatttaatatataaaacaaaattatttaagatataaaagacaatcacatggatattttcaaattataaatatgataactgaaataaaaaatctaaaggagggctcaaaagcaaaatgtaggtgatagtgagaagtagcaaagaacttgaaaacataaaaattacccagtatgatcaacagagagaaaataaaccagaaaaaaaaaaaaaaagggcggcc

SEQ ID NO: 2051 - DNA, 1272 bp, Homo sapiens
cccacgcgtccgggatgctttttgccagcaatgtgagaaaaggtgctcttctgggagagaggaagagacccaggcaatttattatgaatgctccccgttgtatggataatcctgtgctcctctgcccaattcccgcacctctggaaacttcattcacatttggcacagatgagccactcctccctccttccccttgagaatcgttctctgagcctgtgcagaacaaggtgctccgatcctctatcttgcacactggctcctttcctccccccaactgtctccctgtccaccctgtcgtcggctctccagtcctccttctgtagtttcttcctcagaagacagtgtcgcccctcatgctcacctgtaccaggggtccatatttctaactttggaagtgcctcctggacatgtccatgtggttgcctggccatccactcaaatccagcctctccaaaaggaatgattctcccctacttccttctcacacaattgtgtggccagagtagccggaccaatggctccaaactacccccaaatactcatccccgcctcamtgcttgggcccccttggcttcccctagggcagctcacatcaaggtccagcttggatcggagctcctacaggaagcttccccagccctgctctgtcggagaactcttctcctccatactamctctcccattctgtggcaggctcttctttaycctcaggcttcagytcagacwtccctcacctgctaggccacagcagctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaaaaaaaaaaaaaaaaaaaaaaaaaaaaaaaaaaaaaaaaaaaaaaaaactcga

SEQ ID NO: 2052 - DNA, 2008 bp, Homo sapiens
  misc_feature (1936)..(1936): n equals a,t,g, or c
  misc_feature (1977)..(1978): n equals a,t,g, or c
cccacgcgtccgccgagttcagcatctggacccgggaggctggcgctgggggcctgtccattgctgtggagggtcctagcaaagcggcagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggargcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggntgtcgcaaaaaaaaaaaaaaaaaaaaaaaaaaaaaaaaaannaaaaaaaaaaaaagggcggccgctctagag

SEQ ID NO: 2053 - DNA, 772 bp, Homo sapiens
ccacgcgtccgatttttttattagccatttttgaactctcttccatttctaagtttctccctgcagctttcctgaacatgaagcatttccttttcttttcatttctagctttcctttctctgtacctcatgtacacttggaagcttcagggacttagcactggtcatgccagcctctacagatcacatctctgtctataattgggtctccatggtaatgagaagcagaaagtgctgaagtagcgcactatgtaaggactggcaagagaaaatactgtcgcggcctctacaggcatagcattgaatccccatggtgcccaagaagcccgagagaagcacgctgtggtgtagagcaggagactgaggacacggacttggcagatttattagcagcaatattctaagatgaaccaaatttaagagtttgtaagtgctcttttcaattggaaaagacctttgaaatttttttttcttttcttttaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgccaaaaaaaaaaaaaaaaaaaaaaaaaaaaaaaaaaaaaaaa

SEQ ID NO: 2054 - DNA, 822 bp, Homo sapiens
ggcacgaggtaaggcaaaactgagactcatgggtgtggtctttgacagtgaaatcttttagctcttgcaagatcacatagaaaatttcaccaagttctaacatccagcaaaatggagaacatgtactggggacctttgggtttaaccagtgagattgtcttgtttatcctgttgcatttagccttccagcttatggaaaaatacaaattcaaattctaacactgctggatttatgatatttaaggtttctattatatcagctgcctggatggagcacagaaacagcgtagtacaatatgctatgggtatattcatgaccaaagtttacaatgtggaaggagaatagaaatgcaagaggtcagttggggaattagctgcttgtgttatataactccttaaaagtggaaaatgatcacaagtaaatgtgagtagtgacagttctcttccatttcctttcttcaggtaaggaaaacacacttaatatttttgagtgtctttaaagatcttcctaaccatccaaaagagaagatgtcttatttatgtgtatatgtcgtgttgttgactgatttttttgctttttactcctgatgtgttttgtgggtgagaaggcaagcatgtaactaagatacagaaaagaccaagatgtagtggggcacagtggcttgacgcctataatctcaactactcagaaggctgaggtggaaggattgcttgaggcgaggagtccaggctgcagtgggctatgattgcaccgccacacttgctgcactctacccttgggggacagagtgaagctctgtctcaaaaaaaaaaaaaaaaaaa

SEQ ID NO: 2055 - DNA, 1488 bp, Homo sapiens
agggtacttgacatgtccacttggatgtttgataatcatttcaaacttaacatattcaaaacagaactcttaatttctacccacgccctaacctacacaaacactggaaactgtccatctcccaattattcttatctcaataaatgaaatgacaccacagccatcaaccagggatcctgtacctcaccttccacatccaaactatcaaaagctcctcctgttttatgcccaatcagatatcgagtcatttcacctctttctgtctcctctgctacttctctcagacatgttgcttcaatttctcacctgaactactacattagcctcctacctggctctgctttcattcctgcctccctgcagttcattcttacagagaatctagaaaaagctcttcaaaagcaacaatcagatgtcactctcctactttctaaaaacttttaaagaggacctcttcttctgccagtataacagactttgtactccaaaggatatctctgttgcattttagaactcctaggaagtaatgaaaatatctaagaaaaaaaatacaagtagctaagtgcatatatgtcaacagtaaacaagccagaaaaggcagaattggccatcccttgtgtttgtgtgtgacggtcatgtgggggtgcaaatggggaccgtactgcaactcccagtttaagcctgggattctagaagggagataaaatagcccaggttggtagtaccactaaattccagataaagcaaatgtaatttaggcttctagttttttttcacagattgggatcttgagctttcaaaaaagattatcaaacaaggaaacaaaccaccgtgagtgaaaatcagcaaaactagcgttaatatattaattactccttccccaccaagggctttagatgtttgaagtatcagataagaagaaactagactaccttatataaagaaaaattaacttaaatatagactacaaaaatggtgaatggtgaacaacaatggtctctcacaatcaccaggcacttctgaaaaagagctaaagaaaaccttcagtaataaaaaaaaattatcaaaaaatttagtggataagcttttttgtaatggactaattaatgaactggaaaataaaactaaaatagtttcatgcaatggagcacagacaaagagatggaactataaggaagagaggttaataagtttggagggcagaataagcaagcctaactaaagcctatttagagcgtgaaaggcaacaaaaatatgcagaatggagatgagacaatgtttaaagagattgtggctcagaatttttctttttttttaagtgaagagttttatcttttgtgttttttgtttgtttgttttctttgtttttttttttactgttattatactttaagttttagggtacatgtgcacgacgtgcagcttcgttacatacgtatacatgtgccatgttggtgtgctgcacccattaactcgtcatttagcatt

SEQ ID NO: 2056 - DNA, 1383 bp, Homo sapiens
ggcacgagcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacmacawtwacwtatyccataatattwcmgcttaattggmaractgtttcagtctataggatctgcaggaaggaggagtaataagggatttttgactgagctcttatggaacagagtctctctaggccccctgtcatatctgcccttctgggccctggggaaaagttggcatccccagttgtggtgctctccaggtgccctcaggctgtggtggagggagcttcccattctctccttcagcccactcaattcagaggctaggggctgaaagaagcttctctacaactggctgttcactgggaggttaagggatgaccatccagccaggccttcctcaggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccatgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaactcgag

SEQ ID NO: 2057 - DNA, 748 bp, Homo sapiens
ggcacgaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagtaagtagattcttctgttttactgcttttaaaaaaagtttaaagttttaaaatagtataaactttaattgggttctttaaattttgttgttgaataatgcaattattatgatattttgtgaatatttgtaaataatgggattctggaataaattaatccccgatgatagaaaagagttaatgaacactttctccatacataacactttagcattcaagaaacataggacttaaatacatatattaaaaatttaggccaggtgcagtggctcacgcctgtaatcccagcactttgggaggctgaggcgggcagatcacctgaggtcaggagtttgagaccagcctagccaacatggtgaaatcccatctcggctaaaaatgcaaaaattagccaggcatggtggcaggtgcctgtaatcccagctactctggaggctgaggcaggagaatcacttgaacctgggaggcagaggttgcagtgagctgagactgtgccactgcactccagtctgggcgacagagaggctctgtctcaaaaaaaaaaaaaaaaaaaaaaaaaaaaa

SEQ ID NO: 2058 - DNA, 1694 bp, Homo sapiens
gggcctcaggactcatctctgtcttctccaaccccagctggcctccatgtcccctgggggctttctgctgctgaccagcttgggccctactataggttttcttgctgggcttaggagcctgagagaggtagccatttccaaaagaaaagatttctatctcagattatctgggaaagaggctgagtaggtcccttctctgaggaaacaggcagcaggacataggatggggcagtgggaggaaaagggtctgcactatggggtccttgggctgtgcactcctgaccttatcacttcacagttcccaccagatctgacttgacctccgggccatgacccagtccctcccccactctggaaacctctgtgtcccctcctgctcctttcactcccacctgggaggctctgagcaggccagggtccctctctccaggcctgctcctccctttctcctcctgtmcccccagccatccccccagccaggctctcccacctctggccccacctcacctcttggccttcttctttccctcgggcgatgggagcctggtttggctgcccagggaagattgtatctgaccacaggagggagggctgagggcactgctgggtgagctgaggcctccttaggttcttgctgtagtctgagttcaagtcatttagaatgagtgacttgaggaagagggagctgggagcccttttcaccagcagggggactggaggagtcgaatggggtggggtcttctcgttttgattagcttctggtggaggtcccaggctttggcgtgctcaagcttggagtggcagggagcaggcctggcttgaccttctttccttcctgctccctctcctcacccctccctgcagctctttcactccgtctctctctctacagatgggacccaggtgagcccgggtgcccactactgcagccccactggcgcaggtaagagtcaaacccgggggagtccatggtagggagtggaagatgaggggtggaaaggctgtaagaacgcgagaagctgaggggttagagaagcagggtcgctggctgatctgccagagagccaggaggtggcggctccagggagggscgaggagccggggtaagagaggcagctctggatgctggctgggcacagtgctaggaaacacaacaggaaaaggaaacacaggatgcccgtcttgtccttgctgggagcagtgaaacaggaaggaaagtaagaagctaatatttatactgagacccctaccccatgtcaggcaccaggcaaggtgtgttcttgtgtgtggactcggtcctcacaccggctctgcaaggtgggcatggcagcccttgcaggactgctctgctggaggggaagtgttctctcactgtctgcgcctcctccctctgctggcccgagcctcctctgctgctaggctgccctggggaaggactggacttcctgctgctgctttggtttaggacatgcccatggggccaggtctggactagacgcggtctgcccttcctttagtgtagccagtatcaaccaagggcctactgagtgcaagatatacagcctgatgcctaataattccatatagcagggagaaatggaacccaggtatcctccttgcttcagtcctggctgttgaaaagctwacaggcaggttagggaggaagcacacacaaatacaaaacaaaaaaaaag

SEQ ID NO: 2059 - DNA, 1572 bp, Homo sapiens
gatcccttgagggcctgaataaaataaaagacaaagagagagcaaatttgtactcagcttgagcttggatatccctcaggccctccctcaggccttctcatcagactgagatttaacactattagctctgtcggcctccagcttgcacacggcagactgtgggactttctagcctccataattgcatgagccaatccctcataataaatctgtttctatgtatctatattttgttggttctctctggagaaccctgactaaatacactgtttaagaaaggagtaaaacttgcactgagatgtttagagcagctttattcatagtttatcaaaatgtggaagcaatcaaggtgttctccagtaggggaaggaataaataaactgtggtatctccgtaaaatgggatgttattccacactaaaaagaaatgagctatcaaccatgasaatacatggrggaaccttaaatgcatattactaggcaaagaagccattctgaaaaggctatatactgtgtgattccaacttcatgacattytggaaaaggcaaaactatggagacaataaaaggatcagagatgccaggggttgggaaggagggtaaattaataggtggaacacaggatttttagagcagtgaaactattctgtatgatataacaatggtggatacatatcattattcatttgccttaacccacacaatgtacagtaatgaaagtgtactgttaggtaaactgtggactttagatgatgatgtgtcactgtaggttcatccattggaataaatgcaccactcttgtgtgggatattgatagtgggaagactgcccaattaagaaatctgtactttctactcaattttgctgtacatttaaactgctctaaaaaataaactctgttttagcctgtaaccccagcactttgggaggctgagggggtgtatcacttaaggccgggagttcctgaccagactggccaacatggtgaaaccttgtctctactaaaaatacaaaaattagccgggtgctgtggtgcatgcctgtaataccagctatttaagaggcatgagaatcgcttgaacctgggacgggggttgccagtgagcccaagatcctggcactgcacttcagcctgggtgacagagcgagactctgtctcaaaaataaatacataaatacataaataaactctgtttttaaaaatgagcaaaaggccaggcacggtggctcacacttgtaatcctagcactttgggaggccgaggcgggaggatcacttgaggtcaggagttcaagaccagcctggccaacatggcaaaaccccatctttactaaaaatatcaaaattagccaggcatggtggcatatgcctgcagtcccagctacttgggaggctgaggtgggagaatcgcttgaactcgagaggtggagaatgcaatgagctgagatcacaccactgtactccagcctgggcaacagagcaagagtccgtctcaaaacaaacaaacaaaaaaaaaaaaaaaaaactcgagggggggyyccgtacccaatcgccctgatgatgtatggtatac

SEQ ID NO: 2060 - DNA, 1265 bp, Homo sapiens
gcaacattatctgcctttgaaacaccacctccgtggattaccatttggcccaatgggagggtctggataatgcccattatattatcctaattccctgctacctcagaggttgttaaggggcacttctgctgtttccctctgagtgacctctggctgccactctcttgcagatgctccttttcctctcagggatgagtcggagctgggactgggaaaggcagccctcttgtttctgttcaagttggccaggaatgcccaggaatgatgattctgttttgccagcttcttgccgtgagctggggttgctgtgtttacagcacaaccaaccctaaagtcagtgcaattcactgtggatttattgagcacctgctagtatgtgcgtgtgttgggggtggtatatgaaaatgatggaggcagtctctgccttaaatgagggagggtgggcaaacagctcccacggtcggcggttgaaccagttcctattctttctcataggaagtgtccataaacattgtcttgtctcatttgcatggttgttgagaggtttgaatgtagtggtaatgaattgagagtgcttctaaaggtattaagctcttgatttatgtaaaactttcttcagtattactaggcaggctgataataaaagctaacatatattgaatgctttctatttgccaggcactgccctaagtgctttctatatattagcttatttaatctttatagcaactttgaagtagattgcttgtgtacccacttaaaagaggattaaaaaaacttgccgaggatggcacagcaggtaagtagcagagccaggcagtctgaacgtttggccaaacactggccactgtaaagatcttgtggaagtcagggagtagaggtggtctctctcccccaagtgaaggcagcagccaggacctaccgtcagagaccagcaaggagcagagaaaggtcaggctggtgcctcagaaagcatcagcatttctgcacaacttaattaaattactgaaaccttttctgagcttggagccatctttcttggagagtaatacaattgaaacagataatttaagccaaggaggaaggacagaattggtgagctcacatatgtagatggacatgtaatgacgtctgactaaaacacagaggaaaaaccttaaagtgaatcatgtttattcaatttccaaacaagtgcaaagacccaggcagcgtgcttcatgtttggactcttgaagaacacacatggaaaaaaaaaaaaaaaaaaa

SEQ ID NO: 2061 - DNA, 3332 bp, Homo sapiens
  misc_feature (16)..(16): n equals a,t,g, or c
  misc_feature (28)..(28): n equals a,t,g, or c
  misc_feature (30)..(30): n equals a,t,g, or c
  misc_feature (32)..(32): n equals a,t,g, or c
  misc_feature (44)..(44): n equals a,t,g, or c
  misc_feature (625)..(625): n equals a,t,g, or c
  misc_feature (3138)..(3138): n equals a,t,g, or c
  misc_feature (3315)..(3315): n equals a,t,g, or c
  misc_feature (3332)..(3332): n equals a,t,g, or c
actattcagtgcacangacacaagtcancngncagtcacggtcngattcccgggtcgacccacgcgtccggttattaacctctctaaatttcagggggaaaatgtataaatatgtcatgtatttgataaatagttttccctttttttaatgaaaagattatctgattggattgacctgcctactaatttttgctattaactttttcattcttaggcaataagcaacaaagaccagcatagcatatcatatactttrtctcgggcccagactgtggtggttgaatatactcatgacagcaacacmgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggnaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttaycctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataattgaattcgtctctgtgagtncatttttgcataatcgagaatgagaaaccagaagtgaaaactgtgaacaactctattccacactccaaaaatactcatttgaaatagatgaagagtttgcatttaatgtaacactttaaagtatctggttcttttttaaaagcatctcttactaataaaggaactttgttagtggtngaataaaaaaaaaaaan

SEQ ID NO: 2062 - DNA, 1314 bp, Homo sapiens
ggcacgaggagatcttgagtcacagtgaagcaacccactggagtgagcattgctgcatttggagagtcagatgscattttgggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttcsggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtaaaaaaaaaaaaaaaaaaaaaaaaaactcga

SEQ ID NO: 2063 - DNA, 2545 bp, Homo sapiens
ggcacgaggagatcttgagtcacagtgaagcaacccactggagtgagcattgctgcatttggagagtcagatgscattttgggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttcsggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggaaaaaaaaaaaaaaaaaaaaaaaaaaaaaaaaaaaaaaaaaaaaaaaaactcga

SEQ ID NO: 2064 - DNA, 1564 bp, Homo sapiens
  misc_feature (50)..(50): n equals a,t,g, or c
aaactgcagtttaaaagtgtttatatcctggatacactaacagcattttntccaacttgtggagtggagggagtagggaaggggaggatagtgctaatgaactgtgacaggggctagcaagaaagaaagaaaaagagttccctaagtaagctcctactgggtgtcctccactcacatggagacagggccctgcttttaggcacttactcttccagtgtctattgyataatatgttcaggaaggatcccagattcaaagatttatagaattagrgttaaaagggatagatatcttgtttgaccctgaaaaaattaaggaatatgcttgagatattcaatggcagaggctggaatagattttcccaaatctcctgatgtgaagttctgtgtttgtcaaacatgactgtgtaaaaagattaatttaaacttaatgacatgttgtattcatagaagttctttgggtttctgtggaaacctcctcttgctagcttaagcagaaatgggggatttattggaaggaagctgagatattgcaccaaactgcacaaaattgaatgaagagctgactaagcaaggctgcactgagaaggaaccagggtggtctgggctgtggtagcggcagcagcagcttgcagatctcccagcgctgatgctggctcgactcagacaggtctccactctctgctgtctgtctctggctcagacaggacactttgtgtggctgtttccttccacaaggcctcagtgggagcaagccagcctcccacaggcctctgagacagaccaccccattcctccctctcctgttaacctgcctttatttccttaattgcacttatcaccatgcagaagcctatgtgtttgttcccctgtggagatgtaaaaacactgatgcccaggcctaactcccagagactctgattgaactggtctgggctatggagccgggacatttgcatttttcttacaagctctaatgtgcagccaggattaagaatcattgccttctgcatcaacaggacaaatacaaaatgtgcagcaaaatatatgtttaagtgaatcaagaagacagatctagaaacgattgttaaggaataataatgcattttgtccatcaccacacataagtgatgttgaccagagccctcccagattgagtggtgccaggtgttcggggttgtctcggttaatccttactatggccttgcggggtagggggcagtgtcctcattgtccaaatgagtcactgaggctgagggattcaggctcagtgtatgcccacagttctttggcaaaccccaccactgggccagccaactacacggggattctgatcgggtcctgatgggtgcccatgatgggctgtgcaaaagtggtggtgagatttctccaccttcacggaggtggtacccaggggaggtggacttcagcagcgagaatgggctgggtgcagtggctcacagctgtaatcccagtgctttgggagttcgaggcaggagaattgcatgagctcagttgttcgagaccatgggagaccctgtctctacaaaaaaaaaaaaaaaaaa

SEQ ID NO: 2065 - DNA, 914 bp, Homo sapiens
ggcacgagaagctatccatgaaaacactttgtgatgtgctgttttatatcacagaatggaacctgtgttttgattcaacaagttcaaaacactcttttcataaaatctaagaagttatgtttctgaacctattgagcctttataggaacatatgaatatccagtcctaaaaactagaaatgagcgatctgtgaaaacactttgtgatgtgctgtttcatatcacagaatgggacctgtgttttgaagaaaccaaccctactgacaccttgatcttggacttctagtctcagaactatcttgggacatttcctataaatagatgcatgcaatacgtggctttggaagatggattttaaccaactctactgacgagtctgctttaggactcttggtccagactgacttcatggagagtgttgggggttgtgggagaggccaagcctacaagctgtgggaagctggtggatggaaggctggttagaattcttcaggatctggggaacctcagagagtgctgaaacctgttgggacgttggatgagccaatacttggcaaacgcaagaatacaaaggtttctttctttctttttctttttccagatactcaaaagctggggccatgttacatgtgcccagctgtttcattagttaatatcttttggttgcaggccatggcaaccaaatctaaagtaacttaaacaagaaaaggaatgttttggctcatgaaataaaaaagtttagggatggccaggcatggtggctcccacctgtaatctcagcactttaggaggctgagacaggagaattgcttgaacctgggaggtggaggttgcagtgagctaagatggcaccattgcactccagcctggcggacaaagtgagactccatccccctcaaaaaaaaaaaaaaaaaa

SEQ ID NO: 2066 - DNA, 2235 bp, Homo sapiens
  misc_feature (1097)..(1097): n equals a,t,g, or c
cacgagggaattacaggcgtgaactaccgtgcccagcctttttttcatagcagttttattaagttgtatttgccataccacccaatgtatccatttaagcacctgattcagtggtttttcatgtactcatggagttatgcagccacaatcttagcgcattttcattaccccaaaaagaaactgtacccattatgcaccccgttcccctcctccggtcctggcaaccacgagtctactgtctgtcttcatggatttgcctattctcgacgtttcattgggatgaaatcacacagtgtatggcttcccacactttactgtgctgttgtcaaggtttatctatgtgttgggtgcagccaccccttggtatccacagggattggacccaggagcctgcaccgatcccctgcagggatgcctgtgtcccacagtgccccctgcaaaactcactgatatgaagagtcggccctctgtatccatgggcttcagatcccgtgattactgtatcttctgtctgtgtgcagttgaatctgcgggtgtagaacccacagacacagggagtggctgtagcttatccctttgtatggtcagagagtgttccgtagcggggatggacacgtgttcattcactcttccactgatgggcatcgggaatgtttccactttctgtctatcattaacaattctgctacaaacatacatgtacttctgttggaggggacacatgttttcatttctcttgggtgtgtctatccaggagtggaattggctgggtcttatggtaactctgttaactgttttttgctttttggttttttgtttgtttgttttttgagacggagtttcacccttgctgtgaactaccataggctggagtacaatggcgcaatcccagctcagcacaacctctgcctcgtagattcaagccagcagggcgagcctctaccccagagtgaaggtggactttgccctctcgtgccacgagkacttgctggcacccatctctgagcccatcgagtggaaataccacagcccatgaggagtggaaatgaggaagtgctggctgatgtccgcaccatcgtgaaccagatcagctacancccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaaaaaaaaaaaaaaaaaaaaaaaaactcgtag

SEQ ID NO: 2067 - DNA, 1369 bp, Homo sapiens
aagatctagttagagaaaggttttgaacagtgggaaactaagtgggcagggatgtgacttctgtagccacccgaatgtttgtgtctctgactgtttgagcttagctctccttgctggtttcatttgctcttatggcagacagtgtgctctggtggcgctggaagatgttaaggcgtatctcactgaggagaatggtcagattgcggtaagctttatctgctgcttcttctttctggtccccacccttgcagcagcctggctacccagccccaccttgagtctgccctggtggggttctgtttctctgttcctgctcatttaccttgtgtactttcttcacaggtgtttgatgccaccaatacaacccgggagaggagggacatgattttgaactttgctgaacagaattccttcaaggtaggatctgactccatgttggaggaaaagggatgagtagaggtggggagtcaggctacaggcatggatctctcactctagtgggtgaggacaggatgggatatctgaatctcttctctcagagcattcccccagtccttgagtgttttcattcaggtcctttctcagactgttagcctgtatgtttgaggcccaggggctgtggtaagagctatgaggaggacttgagggccactttcatgaagaaaatcctgggagatgtggtggctgggtggggtagatgagcatgtgctcttaattaacagcctggcatttttgacttgcttatcactgccttctctccatggccaggtattctttgtggaatccgtctgtgatgatcctgatgtcattgctgccaatattctggttggtgacacccctacatatcatctcctcttcaccttttgtgctgtgtgtgttgtggggtgtgtgtgtgtgtgtgtgtgtgtgtgttgttggggaggggtgttttcgtaatgaaagagagaaatagacatgtttaacatcacaaagagatcttttctatctgccagagccccatctggtacttctacactcttctcttgggagaggaaactgaggctttaaggaatcaagtaagaattagctgttgaattgaaaccagggtttaggttgtaggattcttggccctgtgctctaggtattatctggatgttgagacctagatgttggaatagatcagccgggcacggtggctcatgcttgtaggctcagcactttgggaggccgaggcaagtggattgcttgaacccagaaggatcaccttagcctgggaggttgaggccacagtgagccgtgattgtgccactgcagtccagtcttggtgacagagtgagaacatgtccagtcttggtaacagagtgagaacatgtctcaaaaaaaaaaaaaa

SEQ ID NO: 2068 - DNA, 2910 bp, Homo sapiens
aattcggcacaggggcagtctggsatgatctttttggaggtaagttgtgcctcactgaaaactaatccccagcccatctttgcctgctttctagccctgtctatcctgaagcgggctcgccgggaagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcagkagcaagcccgtgcacggcacgagaagctccgccagcgcttgaaagaggagaagttggagatgctgcagtggaagctttcggcagctggggtaccccaggcagaggcagggctgccacctgtggtggatgccattkatgacgcctctgtggaggargacttggsagtcgctktggcaggtggccggttggaagaagtgagcttcctacagccctwsccagcccggcgmcgtcgagctctgctgagggcttcaggtgtgcgaaggatcgatcgggaggagawgcgggagctgcaggcactgcgccaatcccgggaggattgtggctgtcactgcgataggatctgcgaccctgagacctgcagctgcakcctggcaggcatcaagtgccagatggaccacacagcattcccctgtggctgctgcagggagggctgtgagaaccccatgggccgtgtggaatttaatcaggcaagagttcagacccatttmatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttcyacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcrtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgygggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttatttttaaaaaaaaaaaaaaaaaaaaaaaaaaaaaaaaaaaaaaaaagggcggccgc

SEQ ID NO: 2069 - DNA, 2430 bp, Homo sapiens
  misc_feature (5)..(5): n equals a,t,g, or c
  misc_feature (8)..(8): n equals a,t,g, or c
  misc_feature (11)..(11): n equals a,t,g, or c
ccagnttnggngcttcccagcccggcgmcgtcgagctctgctgagggcttcaggtgtgcgaaggatcgatcgggaggagawgcgggagctgcaggcactgcgccaatcccgggaggattgtggctgtcactgcgataggatctgcgaccctgagacctgcagctgcakcctggcaggcatcaagtgccagatggaccacacagcattcccctgtggctgctgcagggagggctgtgagaaccccatgggccgtgtggaatttaatcaggcaagagttcagacccatttmatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttcyacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcrtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgygggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttatttttaaaaaaaaaaaaaaaaamaamaaaaaaaaaaaaaaaaaaaagggcggccgc

SEQ ID NO: 2070 - DNA, 1525 bp, Homo sapiens
  misc_feature (1499)..(1499): n equals a,t,g, or c
  misc_feature (1502)..(1502): n equals a,t,g, or c
gaattcggacgagcagttgaaaaacccttagtcactttgacacatctgctctttacactggtattttcttggtttaagtgacgacatactgaaatgactgggtcaaatcaacaaatcagatattgcaaaaccagtatttttccaaaaattgactgtatatataaagtcagccagtgctgcttcgtatttttagatagtaagtgcagaaatataacttcctcttctttctgtctctagtttttactgttgacctatccctatgctcctcaactggacgctagtctcttgtaggaaataaatctctttaagaaagatgaaagaagttgcaaactttgaaacaaaaatgggtggagtacaratctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtytgagatggggtgckgcaaagatcattaataaagtncantattatagacagtctaaaaaaaa

SEQ ID NO: 2071 - DNA, 2399 bp, Homo sapiens
ccctgctgagaatggatttgtttgtgttctataccttggtgtcatgaagtccgataattaatgtaaaattctcaatttcccgcctagcccaaaataagtactcagcaatgttggttgactgtgtcctatttaataatatttttatggcaccatgctccattaaactcagaacaatttgtagaagtcttctaatttatcttcgactatagattccagaactctttgacttacatttgactaagtaaaaagatgtctttctgcctctagaagacagtttttcctagaaacattgattctgatgcctaattttctttacccattaattcatggacttatttttattgtttttcacacatcctcacaatctttgccaggaacatggtgagcaggaatacttacctttcagggcagggagaaaggtcagagcctcaggtggcctctgagtgacctcagtgctagagctgtccacctgtttatactcctggctatcacacctttatcccatcacagaagcttacaaaaggagtaattattagagtttgctttgtaaagcctaattttggatttccatttaataattaaagctggttttagggaagcccctaaaccaacctgagttttcttgaaatactaacttgtgtcttgctgttatctgagtcacacttttatcctaatttttagatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtaggtagcctgggccctccaagctgcttttccagtttgactgatcagtagaacttttaggcctctagagatgaatctggaagagtaaaggtaagttatccttgctaatatgttctccgtgtagattagctacagacatctttgtgtaattgaagagctttgttccttatttattgtatctcacttaaattaccttcaaactttagctttcactttctgtaaaaaaagataagggaggtttacaaagaacacttaagacttctggtcccttttaggacttcagtggggatgtttctcttggaaagtggtaggttttttctaaatgcagtagatcagaagttctaaactgagttcgtggcccccgtggggtcctggtagtttattcatggcacatcctaggccaaaggaaacacctaatggtatttccgtttacaaagtaagtcagtctaaacaacaagtacatatgtcctaacaacttagtaggtgtttgaaaaaataataacacataaatggaaagaataatattttatttaattcttaagtaaccacaatgactggtaggaggtatgtgcctgttaggtattgcataacttctcaaacttggaatcaggttggacattacaaccctcacttcctgtccacatttatcttcttatggtacttgctttttctcacagcaaccgctgaagacccagcttcgcaaagataataccttactgaaaggagtatagaatgatctattattgaatgccaactaccacaagctactagttagtgcagtgtctggcagatgttgtttttccttcaaaaatttaaaatgtcctggcagccgggtgtggtggctcacgcctgtaaatcctagcactttgggaggccgaggcgggcagatcacgaggtccagagatcgagaccatcctggccaacatgacgaaaccccgtctttactaaaatacaaaaattagctgggcatggtggcacgtgcctgtagtcccagctattcgggaggctaaggcaggagaatcgcttgaacctgggaggcggaggttggagtgagccgaggtggcgccactgcactccagtctggcgacagagcgagactccgtctcaaaaaaaaaagtcctgacagctgcaagcctttgccaccctgtggtgtctcagtgcagtttgggaaccatagaaaataacaatgtacttttgtaacaacgtgttatttttcctttttttaaaaaaactttatggccaggcgtggtggctcacacctgtaatcccagcactttggggggcgaggcgggcaaatcacttgagctcaggaattcgtgaccagcctgggcaacatggtggaattctgtctctacaagaaatacagaaattagccgggtgtggtgaggcatgtgtctgtagtcccaggtacttgggaggctgaggtgggaggatggcttgagcccaggaggtggaggttgcagtgagctgagatcatgccacctgcacttcagccttggtgacagagccaccatgactcaaaaaaaaaaaaaaaaaa

SEQ ID NO: 2072 - DNA, 1709 bp, Homo sapiens
agcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctsatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggttttwttggtttgtttttgtttttgtttttttatcaaatcctgcctgactgtctgcttgttttgcctaccatcgtgacatctccatggctgtaccaccttgtcgggtagcttatcagactgatgttgactgtyraatctcatggcaacaccagtcgatgggctgtctgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctactttgtataagtctcattttgtgccttacacatctgcagtatttatcatgttccaacttggtgactgtcaggcagtgcaatacatc

SEQ ID NO: 2073 - DNA, 2847 bp, Homo sapiens
  misc_feature (2734)..(2734): n equals a,t,g, or c
ggcacgagatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttctcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtngctggttgaaaattcaggaatatgtaaaactttttggtatttaattaaattgattccttttcttaattttaaaaaaaaaaaaaaaaaaaaaaaaaaaaaaaaaaaaaaaaaaa

SEQ ID NO: 2074 - DNA, 2661 bp, Homo sapiens
ggcacgagcacaggctcctcgtggctgggggtgctgagagctgaggcttggggagctggaggctctgcgcggatggtgctttttaatggatctgagtgttcctcgtgactgcatggctgtgaaatatttaaatggttctgcagagctcagaaaaaaagggaattcttcctcctgcccagaggccaacacagttagcctgggcttgtgtgtctgtttatgtacgtgtgcatatgtatgtatgtgcatgtgtatttgtgtgtgcgtattgtgtgcacatgtgtgtctcacgtctatgtgtgtctttctgggggatgtgtgtttctgtgcttttgtgactaggaacacgcacatatatgtgtagatgcccccagaaggtggaaatcctcacggggtctgcacttggccttctcccagcaccaagtcctgggatggagacccgaatgagcataagggtggccttgaaggaaggcactttggcacttgaggtttgtgaaacttaggagcacatgcccactgtggccagcagcccctgggacactgcaccttgcggagcacacgtgtgatggggtgtggcccactgggcagcttcgcaagagcagaactggagacgacctcagtgccaggcacaggcccttgtgtccgggctgtcctcacccagaccctgggcagcctgggaggaagcccctaagtggacagtggtgggacagggacacacagtccgggaggtggctctgggcaaacctcctccaagctgcaatctgctggtctgtagaatgggagaggaacacagcctctcacttggtgagtgccctggctgtgctggggcctgggggaatcccagggagtgcagcgtcaggcccagggtgggagaggcaaagtagacaccccatagaggcttcggggtatgcatggagtgacccgagagcacaccagggccccagggacagcgctgctgggtggcccaggtaaaggcggctgtccctgtgcgcacatgtgtccacgtgaacttgctacttagagagcagctgatgctgaaggcaggttgttggaattcccaggcccaggtgtaagcagcagagcccaccagtgtcccctgacgcccactctcttcctcctgggcacataattttagatgaaactgaaaaacacgcagcatgaaagcaaggcccctgccctctgctggttctgtattggctgcctcgtgtatttttccagcctgcagaaagtcgaggcctggatggataccatgtccacccctccctgtggccctgcggcaccccggcctcccggcctgcatctttcatgagtctggaaacaggatctcccagagagggccccaggaggttggctgccagcagtgggttctcacagctgcctccaagcaggtgaccagtcctgggaggctgtggtctagggcctggcaactcaggggcgcctgtggacaaagggccgggccaaggggctggcaggtttgtcctgagtgactgaagagggccccaccagggcagcttgagaggggcagactcttgctccagagaaagaggaagtttggtacttagcttggaatgaagggccagccctagagaggaccttcctgtggcaggagagagggccatgtcctgccaggggaagtcctgggaggcttcctggaagcagtggcctctgtgtggggccttggagcttgagagtgtctggcaccagggaaaggcattgggggcttcgagagaactgcagggggccctgaccagataggcccctaaggcaaagaggattccatcagaactcgcattcccattttattactctgggaagtaatgtggaagctaagctccactgtatgtcgtatgctgaggcatctgttgagcctctgctgtgtcggggccgggctctgggtggcccacctcagtgaagtcttgctgctaatggccgaatagttctgcaaggcctgtgctgaggcctggagccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagttcgccttctatgtgcccctggtggtcctcatctccatctcccttgtgctgcagatcggcgtgggggtgctgtcatcttccttggtaggtccccaggtgggggcagccaggccacctgctcaccttgctggcatctgctcgcatcgcctgggacaggtgcccaccaccttgcacacttggctctcaggagctgccgattcctggccctcatcacccagacatgcagtccaggaagtggcaccccccctccccccaccctgcactttggtttttgttttgttttgttttgttttttgaaacaaggtccccctctgtcacccaggctggaatgcagtggcgcagtctcggctcactgcaagctgcatctcctgggctcaagcgatcctcccacctcagctcccagctctcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaaaaaaaaaaaaaaa

SEQ ID NO: 2075 - DNA, 994 bp, Homo sapiens
ggcacgagtttttttctttttatttgagaaaagggggggttgagagtagagtgggaatggcaagaagtagtatgacagagcttcttctctttttttcccctctttaccaggaagttaactagaagtcctcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctggggtacctacaagtttgtagtcggagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctccccccctctagagctcagctagggcaggctgccactgcggattggggggccaagaggcccagggcaagaagaaagtgggttgaaagcagagttctgtttaaagaattttctgctggaaactagcccagagggagtaaagaggaactttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtggggttttgctttgttgttgttgtttttttttgaatggccaaatcctcgttttaaaaaaaaaaaaaaaaaaaaaaaaaa

SEQ ID NO: 2076 - DNA, 793 bp, Homo sapiens
gaaccagtttttttctgactgcctccagcatgagctgaatttccgtctgtgcagttatcctcagccaattgaaaatcacctggagttgtattccaagcacaaaagaaggtcagagagtggaggcccgatgatcatgatcgccctgtctccagggcctaggctggaaggagtcctgcagcctttgtggctcaggaccagagagctgaccttgaccctgaccttgtgatcccaggcatcagtggctggaaattcctttcattttattgttgagcccagaagcgcccagctctctttggcaaggttaagctagggtaagaggcactgttactagagtgaccagagttctttaagcgtcgctctgctattactcagttaaccttattaataccctgcctggccaacacagtgaaaccctgtctctactaaaaatacaaaaattagctgggcatggtggcaggcgcctgtaatcccagctactcgggaggctgaggcaggagaatcgcttgaacccaggaggcagaggttgcaatgagccgagattgcactactgcactccagcctgggcaacagagctagactctgtctcaaaaaaaaaaaaaaaaaaaaatttttaaatataattcacataacataaatgtaattatttggcctggtcctggtgactcacaactggattcccatcactttgggagactgaggcaggaggattgcttgaggctgggagtttgagaccagtttgggcaacagagcaagaccctgtttctttaaaaaaaaaaaaaaaaaaaaactcgag

SEQ ID NO: 2077 - DNA, 1482 bp, Homo sapiens
gtttttattttgttgtagagatgggacctcagtatgttgccacggctgaccttgaactcctgcactcaagggattttcctgccctggcctcccaaagtattggtattacaggcatgagccattgtgcccaccgtctctggttcttaaccttctgcctccctcttccagttttaaagaatgcttgtaattacatgggctctcctagatactccaggataatcttgttttaaggtcagctgatgagcaacattaattttatctgcactcttaattcccccttcctatgtaattgtgctgtgtaacataggacatgagcaattggtggcggtgggggttattactttggccaccacagtaactattttatgccaggtactcagctaagcactggtgaattaagcatgaataacacacactccctaatctccatccattcatgggaggagcacytcacctgccatgctcctgagaatctcgggagtcagagaagtcttctatgaggaggtgatgccaaagcggacaagtgacagaggagtcgaagctagctaggmagagagtagaggtttaaggggaagcataktataagcagaggatattacccacttcagagactcccagaggagaaagagtgtgcgttsaaggggcagatgaggctcagttggactccatagcagatgwaatggagaggggcaagcagtgaggctgccttgcaaggcagggcagagcaggggctgttaaggagtttggacttaatccctgaggcaaggagaagtgatgtaaatgggggagtaacatgatgagattcatggattagagacatggctcaggctgctgtagagaaggtgccagggagagcagatggctcaatgggtgtgcaggagacctctcactgagtttagggagaggtttgtaaaacagaagaagtttgagtaatttaaatgatgatgggaaggagctaaaagtgggggataggttaaagatacaggaaaaaagaaagaaaagaaaaattccatatctgagtgtttactcctgagtttttgagattgctattaagatcgtgctctactgtgatgatttgggtttgtttgataatcagaaaaaagcatattcttttgggtgttcagccacactgctttggtgtcacaactgcacattggtttcacagctgcaggagcaagttcgagcatcttaaaatgattcaacaggaggagataaggaagctcgaggaagagaaaaaaacamctggaaggagaaatcatagatttttataaaatgaaaagctkcctctgaagcactgcagactcagctgagcacygatacaaagaaagacaamcatcgtaagaagcaatagtttctcttactattctgagagccttatcattctacatcccatcttcctgtgagwttgtctttgtagcatttaactctaattgcagttctcwttttaaaaaytggcttgcttattgtatattttccccaact

SEQ ID NO: 2078 - DNA, 1336 bp, Homo sapiens
  misc_feature (221)..(221): n equals a,t,g, or c
gggcacacgttgtacgtgctgacgtagccgggctttccagcgggtatattaggatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctgncctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacagtaagtttttgaagtgtatgttacttgtgatgaagccttactagctagtataacaaatgaacttatccattttttgatttgagggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatgaaagataaaagaaaaaataatccaaatgtctgtcactagcggactagttaaaaaagcattgcaagctgggcacagtagcattcacctgtgaatacactctactccactctgggtaacatgaggaggcctccctaccttcctaagaaaacccaaacaagcactgcatatctacacggctgagtctacaaacatttaacacaaaagaagaaagacataggaaactcttgatattccctcatgggatggtctccatgatacattgttaagaagaaataaagcaaggtgtagaaaaaaaaaaaaaaaaaaactcgag

SEQ ID NO: 2079 - DNA, 2253 bp, Homo sapiens
gacacgagcctacactgacagcccctactcttgccctgcttctgctgccgaaaatttcctgcctcctgacttctacccaccctcggacccagggcagccgtgcccatttccccagggcatggaggaccccccagacacccagttctatgtaggatcttctctgccacaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctggcttaactctggggtccaggttgacctggaagccagagacttcgaagggtaaagttgggtgtggcaaggggctgggtgtgggttggggtggcttggccaaggtgggtgcagatgcgggtccctcactgtctccattctgcaggcctcaccccgctccacacggccattctggcccttaacgttgctatgcgcccttccgacctctgtccccgggtgctgagcacacaggcccgagacaggctggattgtgtccacatgttgctgcaaatgggtgctaatcacaccagccaggagatcaagagcaccaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacgttaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgtcagtgagccgagattgtgccactgcactccagcctaggtgacaaagagagactctgtctcaaaaaaaaaaaaaaaaaaaaaaaaaaaaaaaaaaaaaaaaaaaaaa

SEQ ID NO: 2080 - DNA, 1481 bp, Homo sapiens
ggcatcaaccccgtggtcccaggggagacctccgctgaggctcgccccgagactcgagcccagcccagcagccccctggaagggcaggccgaaggtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgcagctgccccgactgtggtgaagcgtcatcctggcacggaggccacgtcagctgctcgggggcatgcgcaaccagattgtcccgacgccacaaggaccacgcctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccaaaaaaaaaaaaaaaaaaaaaaaaaaaaaaaaaaaaaaaaaaaaaaaaaaaaaaaaaaaaaaaaaaaa

SEQ ID NO: 2081 - DNA, 1268 bp, Homo sapiens
tacacaaactcttaagaaaacaaatattgatatccaaaacattttaataattacattgaaattttctattgcagaaactgtgtttccaatctaaattattaattaatcctaaccctttcctgctctgggtttgtgtttttgaattcagtacatcatcttacagtttttgcttttgttaaaatactggaaataattttgaggaagaaaagaaaataagaagtgatatgtcaccttctaaattgtctttcctaacttagaagcaaattcgaatgtctctagtatggcttttctctccttatttcccctatcatcccttttctcacacttctctttatttaaaacttgtcttcaaagcacacaaaatagagtcgataagagtctatccagccctgatttctcttggccaaggaatgaaaggctgttctctaaaccttgataggtaaggaatagccccctgtccacctccatcttagtctgtattgctgtaaaggaatacctgaggctggggatttataaagaaaaaaggtttatttggctcatgattttgatatctgtaaaagttcaagattggacattgacatctggcaagggccacaggctgcttccactcatggccgaaggcaaagaggagccagcattgcaaagatcccatgatgagagaggaagcaagagagagaggggaggtggcagactctttttaacaaccagttttctcaggggctaaaagagtaagaactcactcacctgccatccttacccccacagcccccaggatttctctattcatgagggatctgcccccatgacccagacccctcccattaggccccacctccaacattggggatcaaattttaaaatcagagttggaggcgacaagtatccaaactatagcacccacaaaccatctagtttatcttattattataacctgtcatcctaaaagttctcaaaatctggctgggcgcagtggctcacgcctgtaatctcaacattttgggaggccaaggtgggtggatcacttgaggtcaggagtttgagaccaacctggccaacgtgatgaaaccctgtctctactaagaatacaaaaattagccaggcatgatggtgggtgcttgtaatcccagctactctggaggctgaggcaggagaatcgcttgaacctaggagatggaggttgcatgagccaagatcacaccactgcactccagcctgggcaagcgtgagactttgtctcaaaaaaaaaaaaaaaaaaaaaaaaactcgag

SEQ ID NO: 2082 - DNA, 1637 bp, Homo sapiens
tctgcctcccaaagtgctgggattataggcgtgagcaccatatctgttctactgtgaacattttaatgtgtttttttggactttttctaaatacatgcaaatattatgtatgtaggtatgtctgagttttttgggttttgttttgtttttacaaaaatgagatttcaatgttctctttacttgtcaaaatgtgtgtgcagatgacagttggaagagatgccagatgtaaatttacctccctcccctccctctgaggcttgcttgccccatgctgtggttctgtgtgacctcatggacaggagagatttctgtggcattcaggcaatgcagcagggtctggccactgacacaacaaacttgtggttttcaaatacaagtcatacagccaagacacagtgcttgggtttcagggcctggcatagtccagtgtctgattgatttttaaccagctagtgaataaatttgtaataaatgatccagctgaagatctcaatgatttaactgcaatgaaattgcaawgaaacttcccagkggctaaaattttgtgkttcacatttgcaytgctgttagcacaaaagktaattatgatgtgtgtgaaaaatgktagtctgattagttgttcacacacacaaaggagtgcttttcacacatcttaattgcttttctgctaaagaaagtgtaactgcaagtcataaaattataacagcctctaacacgttaattccatttcatcagcggatgatgtatcttgaattttggtgaaaagtgactttagaactcatattgatgaggaaagttgaggttaagatactgctctcatagaagacaattataaaaaattatagttcatactcataaatacacacgtctctgtacagaagtatcgtgaattactattttgggatagtgtcttaggttttactttcttgcatttcgttacccacatggaccagtagattaacagaaaatatggccccagaaagaaagaggatacaggctaaagaagtaaatcaaagaactcgatagcttttctgaaggctaaggtagagaaaatcatcttgaaattcaacacttagaagagaagaaagggttttaaagctgcataaaactaagaagaacctgaaacaggcagaacaccagagtttctatcagagagtaggtaaaatggctagttttttcaccactaagaaaggagataaaagtttctccagcttaaaggagggagggattaaaagagacctgattagtgtctacatgctgcttgcatcccagagatgggcagcaggaaccccaaaaagctttaagaagatggagaatatggggagttttgtttctattctcattgtatagccaggggaaactgcaagtctttcagagaaatgccttgtccagcacagtggatgaggaaagatctgagtgggtggaactgagaggagcctcacccctatgtcagaggcagaggcgtttaaaccatagcaactccatcttgaataggggctgggtaaaataaggctgaggcaggagaattgcttgaacctgggaggccgaagttgcagtgagccaagattttgccactgcattccagcccgggcaacagagtgagactccttctcaaaaaaaaaaaaaaaaaactcgta

SEQ ID NO: 2083 - DNA, 2127 bp, Homo sapiens
ggcacgaggaggaaggcagggtgggctcccgcacgggaggagggccccgctcaggccattggctgtctcctcgctgaaggtggacggcagatgccccaggcctagcctttaaccctaaccgagatgctcagagcagctttaaaggtcagcctctccctggcccaggatggtactcggtacgtcctgacttccctggaattgccacttgcctttgtcatgggtactaggttgggtgatttctgctgatcctgagctttgcttgctctgccccaccaccaacctggtagatgccaggggaccggccattgcggggtccaggacaaggcagagcgaggaaagcagagcacgtacctcctgactccagggcgtaatctgccagcccgatgcggtcctcactgtatcgctgcagggcctgcttcacgatgtggtgcacctgctgcaatgcaggcaccaggagacggttgcagcagggagcagacgtgtccccctgtcacctcgtggccgtgggccaaggacccatgggctgaccccttctaggcttgcactgtgctggtgcccaggcagatgtgggcacactgccacccacccatgccagccccacagcatgcaaagcctcctgcttggcacttccatcctggaacctgccagggtagctggcagtgtgggactgtccagggctcccagggaggagagctgtgggtgggtgtgtggagggggcatgtgggcctcacctcctctgtcactccaatcacaccttctttctgcagcgtcaggctcagggaggccgcggcttccctggccgacttgccctgcatctctgccacatgggtgaggatcttgctctccagctctcgcagctgagcttgcatctcctctctctgaaggagccccacgcggccccctccacctcgggcaaggaactgactgatccaggccgggaactgagattccacctataggaacccaaaggggtgtcaccctggggggcttgcagggacagcaggagctgctatgacagggctagtgcttagctggatagcagggatagggtaggagggaggccactggaggaaagagttatgaacactccatgggcactaacaaaaacaggaagaacgcctgtcagtgagagcccacatgtgtcaaggccaacgccacagtctcttgggcataacagaggctgcaggggcaaggggtgctgctttgcaggccccaggacacgtcgtctcaaaggaggaggagagggaccagcagggccctggtggttcccactcacgtcgtcccgcacggcctggatctgctggggcagcaggcccacttcttccgccaccgagctctgcttcagtgccagagccgccagctcctgctgcaggccggccagctggtcctccagccgcctcagctccttcacagagctctcctggaaggactcctgggtcatgctggtcccagagagagaagagtaagcctcggatctctttggtgggaggtaaggccacaccaaagatgaaagaggaccccctagtgggctcccgtcaggagagcgggtgcccagcactcattgtgaacctgagaaggggcaaggcctctcctgggggttctggctgcagaacccctgcctgtcccaaggagctaattctgagcctgctccctttctaagcccagagtccagaatgtactctgcctcagcctctcacatccctccacaagcatggacatctggggcatgagaaggcagttatgtgaggctgtaagaaaggatgctgtgtctataaatgaatcccggtcctctcacacagcctgccccccgccctcaggacccccctgctaacctccatggcacctcaaagacaggccctgggcaggggtcctgagctgggtttcaacccctccccctaccatctgcttggcaagatgatcagaactctctgctctgcggctctgctccccagtcctgcctggagagtgggtggggctggggaggagcaggccgaggccagctggtggcgtcccagtacctttgccactctgacttcagctgctggatgcgagcctcggactcctgtgtaggaagaagggacaaatacaagaaatactcatctcagaaaaaaaaaaaaaaaaaaaaaa

SEQ ID NO: 2084 - DNA, 1551 bp, Homo sapiens
ggcacgagcctgcctcagcttcccaaggctcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtcccagattcagagattgtaattatttcatgyagggtagggcctggcatctgttttgaaaagcctttccagatgattctgatacaggtcttcagttaagaaccactaatattatcctctagagaatggggatactactttatagtcaaagataatcacttgcatttcacatgagacctttacatgacccaccattagcctacccccatcaccccagttttcacttttttttttttgaggcagttcactcttgtcacccagsccagagtgcaatggcacaatctcggctcactgcaacctctgcctcccgggttcaagtgattctcctggcctctaaattctagatctccaaatctggcttctagggtttgggatcagggaatgaggatttgtccaaaggcatggggtgggaaaaaagactgtttgtttacaagaggtaagatgtcaggaagcagcaatgtgcttacaccactgaggtaggtgtgccctttcagggggggagtttccattctggggatccccattctgaggtttcccagaaggggacagttttcaagcccactttcctgacggttgcatcttgtcgcaggtttcatctcacctttgtcttgctgcccgcaatctctggcttggtcagctcaggaaacccctggtgccagagatccggatgaagatgagggactagttcggcctgttgcggtatctcagcggggtgagacgcctcggtggggaaggcagagtggaaaacccgacgccttccaccagcaactcttgtgaatatgtgtgtgttggggttatgtggctagccaggagtggagatggatagtgtggtctgcagaggatgcattttggagctgacagagctgagtttgagccctggttctgccagtgctggctaggctgtgcacccctgggcaagggtcttcacctctctgggctcatgtcttcagttataaaactggaaaataaaaaaaaaaaaaaaaaaaactcgag

SEQ ID NO: 2085 - DNA, 874 bp, Homo sapiens
ctgcaggctcatacacagtggagctgacctggctgtgctaggttcttggaagtcctggctgaactcagagaactggttcttgggccatgccgggggtgcaggcaagtaagcctgcatgtgggtgaaaggtagccccagcagcaaggctgtaaggaaaagagggaatgagcacttagtgtacacctaccgtgtgccacaccccctccatatgttgcctcattctggccactccgcagcctctggtggtgcctcatgcccactttgcagaggatgagccacaggttctgatcaggtgctggaacaaaccacccttsttaagtgagtcccccacgaacttagaatttgagactcactcattggccaggctcaatggcctctgttctgctatcaagaggctgctgggatgttacccatggcagggatagatggggaagtcaccatattcaaaacaatcatgtgttgaaacacctccccagcttctgatctaccggyagtggyagcggaagcaaayacagcaaatctgaaacccgatgcctacagaacaggggtgtgaaatgtgacgccagaggcccccacacagaagtgggtgtggacagccacctgcctgtgagcaaccaggggaagctagcttggtgccgagtttacacagtgaatgttaaaaagacttcgaagctggccccagtgtattcgcacacagttgagaaaggccagggaggataacaagggctagaatatagggtcagctccctacagttgctgtaaccccctgggcagctccctttacttctctgagcttcagtgacctcctctgtaagtgaggataacatttcccagagtgaggattaaataaaaaaaaaaaaaaaaaaaactcgag

SEQ ID NO: 2086 - DNA, 942 bp, Homo sapiens
ggcacgagaccatgtctgccctcccctctcccctctgccccttctgctctgtgctccttctcccgagtcccccagcccgtgtccctggcctctgtcttctctttctctccctcccacccctaacacctccctccactgtgggaacctgtaaaccccagggttgtgccccttcatggtcccccatccacccccgcaatgtctcatgctcgatatacaaaggccatggtgactttgggtgacatttgggtgctgtggagctcagggtggaaatttccttccggccttgtgatttcaaccctcctcccccacacatgcttggggctgttttgagcacagcaggttgccagctccatccacctcccggtaacctatccgagtagttggagttagggagaaccaggctggggtgagggcatcagcaggccccctgcagcaacagcagcagcaactctcattttctgagggggctacttactgtatgccagtcccttcatattcatctcagcaaacccaccgtaccgtgcctccccaaccagttagaaactcagttgcccacaggggctgggcaggaaggtgaggcaaacttgggctgtccttggccggatctcctgcatctggctcccaagggaagccataaatccagatttttaaatgtaaacgcctgaattttaaatgttggtaatcaattcacttaaaaacatcaccaccaccaccaccaccaccaccaacaaaaaaacccgtagacttgtccctgttacaggcactaggaacacagcagggaacaatcaaaaagtccctggtctggccaggcaaggtggctcatgcctgtaatctcagtacttcaggaggccaaggcaggaggatcacttgagcccaggagttcgagactagcctgggcaacatagcaagacccccgtctctactaaaaaaaaaaaaaaaaaa

SEQ ID NO: 2087 - DNA, 1124 bp, Homo sapiens
aaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtktgtctgcgcccagccatgtgacccygctcgtcccgtctgaaggactctcctaggaggccaggttgcccctccagaccsctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggarggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaaaaaaaaaaaaaaaaaaaaaactcga

SEQ ID NO: 2088 - DNA, 1170 bp, Homo sapiens
gctcctgggcctcacaaagtgttgggattacaggtatgagccacggcacctggcctggtctcttaactggttccctaagacagctggaaatagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttgtccagctctgggatgttaccattccttcaggcgtgctgttttctccttaggcagtcttacacacactcatgacttccttccattgtcctccacacactgatgaccctaaaatcagtatctccagcctaaacctttccactgagttctagacccatatgttgtactatcaacctggcttgtccatttgaatgtcttccaggcacttcagactctcttctctagactttgctggactttcactcttccccctaaaactggctcctcttccactgaaacatgtatgtcattgagaggcaccaccatccacccagtgcctaagccagaaacctaggaatccttgatacctgttctctctcatcctgcatatccaagcctatcagttttatctctaaattatattttggtaggtttacttctttccttttctcccaccaccaccctgctccaagctaccatcatctcacccagaggttgcagtgagcccagatcacgccactgcactccagcctggtgacagagtaagactccatctcaaaaaaaaaaaaaaaaaaaaa

SEQ ID NO: 2089 - DNA, 1150 bp, Homo sapiens
gaattcggcacgagaagcagctcaacgtaatctacctgccactgggcaactagctaatgaccctccacagtgatgctgtattgaggacttggtgttgatctctaccgctggtcagttgggcactcagcggtggctctagccaggtcagctttggtgagtggaagtccatgttgctgagccatgcataacctccatccctgtcaccatggctactttgttcatgagcccactgtggaatgacagcagtggckggagaaagagctgactagtatcacagaatgggctctcctatttccttgatcattaaaatacctctctgctaagatcacctgttggtgagcattcacatgggacacaaatatcttcactataaaggcccagatagtaaatatttcaggctttgtggactacatattgtctctgttacatattctccttttcttctctcccctctcccttctattttccttcttctttatagccctttaaaaacataaaaaccattcttacattgtgtgctatagtttgctgacccccagcttacatgttaaaaaatgcaagattcatttaagtgaaaattgtattgggaaggaatccacatttccagataatgagggttgaggaaggcactgcatttattttaattataaattgggatttaaatctaagaaaacmtgaataaagcacccaaaggtattataaaaacacacacttatgtatatgtgtctatgtgtgtgtgtgtgtgtgtaaagatacacacacatacaattactcaataaataattacaaatcacctaatattttataagtttattaaccaaagttactggcacaaactcagatgcctactaggacctggcagataaaagggcatttttgaagtggttaagtacacagtagtaactgaactgcttatatgtcagtaaattcaaacgttagcagaatgactttgccagactttgtgaggactgagtaaaacatggttccaaacatatatgtggcccctgggtaatcagtttttatgatcacctgtaaaagcagaggcttgtttctaacatctatacttttaagaaattctttttttctcttaccctggtcataagaaaaaagaaaaaaaaaaaaaaaaaaaactcgagggggggcccggtac

SEQ ID NO: 2090 - DNA, 2612 bp, Homo sapiens
gggcgatggtttctggtgggaaggcccaggccgagggcgatggtttctgccgggacggccgaggccgagggcggtggtttctgccgggacggcccagacggaagggatgcggcttgggaggtggggcctgaggatgtggccatggcgcgtgctcttcctggctggtgcctctcctagtcagcttcaggagatgggctgtagatgtacctccactgcccagagctctgcaggggaaggcagtaaaacctccctgcatcctgacccacgtgtttgtagatcctttcagctattggcgccctggaggatgggacgggaaggagaacgtggccggtgggtggaggatagcactggtgcctggccccatgatggctgcaatgcggccacattctcagtgggtcatgtctgaatgcgagagcagctgtgttctgcgagtggtgaaacaattgcctgttgcattctatttataggcagaggtaactaaaaacctcagtgctgagaggggcatcatatagatcctgcagttatgagctggttcacttggagttgttttggttgcaggtgacagaaagcacgactcaaggtagcatcaaccaaacaggggaggtgggagcactcaccaggcagagaagtccctgcccccactgcttgcagcccaacagtgtggccccatatgggtctcccctggactaatggctgcggccttggaagtggtgtgctctgggccaggcctggatcacttgtccatcctgagttgggaatgggggcagcccccagagacagactcaggaaagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagttggaggttcctgtttctagaggaggttcccttgtgaccccctcatttccacacccgagcaatgctgagggctgtggggccccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccactcttagggcacaaatgcaggtgcagcttccccatccccactcttagggcacaaatgcaggtgcagcttccccatccccactctttaggcacaaatgcaggtgcagcttccccatccccactctttaggcacaaatgcaggtgcagcttccccatccccactcttaaggcacaaatgcaggtgcagcttccccatccccactcttaaggcacaaatgcaggtgcagcttccccatccccactctttaggcacaaatgcagtggcagcttccccatcccccactcttagggcacaaatgcaggtgcagcttccccattccccactcttaggcacaaatgccaggtgcagcttccccatccccactcttagggcacaaatgcaggtgcagcttccccatccccactctttaggcacaaatgcaggtgctgtgagcgctttagaatcctctgctgcaggtgactttgcttcagcgaaccacagaatgttcacatggttttatgcatttgttatttcagggaaaatcaaggttaaagatgtcttcagaatttgtatttttgggctgggcacggtggctcacacctgtagtcccagcacttttggaggctgaggcgggcggatcgcgaggtcgggggatcgagaccatcctggctgacacggtgaaactccgtctgtaccaaaaatacaaaaaaattggccggatgtggtggcgggcgcctgtagtcccagctactcgggaggctgaggcaggagaatggcgtgcacccgtgaggcggagcttgcagtgagccgagatggtgctgctgcactccagcctgggctacagagcaagactctgtctcaaaaaaaaaaaaaaaaaa

SEQ ID NO: 2091 - DNA, 1485 bp, Homo sapiens
  misc_feature (1365)..(1365): n equals a,t,g, or c
  misc_feature (1402)..(1402): n equals a,t,g, or c
  misc_feature (1423)..(1423): n equals a,t,g, or c
aggttttgaacaagtaatatgttcatgtggtttaaaatgctaaagttacaacattatacatagttaaaaaaaatctgtcttctaagtagatactccattgtcctctgtagggagaattggagttactagtttcttggctgtcattctatgcatttataaacagttgcatttttttccccttatttttactagcatattatgtatactagtttatacttcgactttcccatgtaatatagaatcttgagagattattctatactgtaacataaaagagcttccttgaaaaaatattcttaaaatagaatattccataaaatattctataaaatactgctttgaatatttgcaccactatctttttttctttttttttttgagatggattctcgctctactgcccaggctggagtacagtggcaccatctcggctcactgcaacccccacctcccaaatctatgatctctttcatatttgcttacttttctattagattgttgatccttcctcttactgatttatagaagccctttgttaggtgcattagctcattgaggtatgagttgaatgtatccagatttataaattttaaaagagggatttacaaaagtcctctaagtcttgctttaagttaatggttagagctgtgaaaacctaattaagtcatttcacacaatgttctcccatgagaaaatccaaagtttgtttaaaattcaaaatttaccattttaatcattttaagtgtatagctaagtggcattaaatacattcacaatattgtataaccaccaccactttctatttccagaagtttttcatcacccaaactacaactctattaaagtaataactactcatttccttcccgtcctcccagcccctggtaacctgtactctgctttctgtctctatgaatttccctactctagatacttcatataagtgggattacacaatgtttttccttttttgtctggcttatttcacttagcataatgttttcaaggctcatccatattgtaagcatacggaggaataatctattggaatatttttatatagcatattatttacatataaattccatatggaggaataatattcaattttttgtgtacaccacatcttggttatccattcatctggtgaaaaataatttgggcctaggcacagtagctcacgtctctaatcccagcacattgggaagctgaggtgggtggattgcctgagcccagaagatcaggaccagcctgggcaacatggcgagaccccatgtctataaaaaatttaaaaattagttgggcgtggtggtgtgcgcctgtagttctagctactcaggaggctgagatgagaggatcacctgngcttaggagatggaggttgcagtgagctgagattgcnccatgcactccaacccgggcnacagagaccctgtctcaaaaaaagttgatgaacgcatacatattaaaaaaaaaaaaaaaaaa

SEQ ID NO: 2092 - DNA, 1566 bp, Homo sapiens
  misc_feature (1013)..(1013): n equals a,t,g, or c
  misc_feature (1020)..(1020): n equals a,t,g, or c
gaattcggcacgaggatttccctgggccattaagaaaagtaccttttaatgtgctcaagaattcagggtttagaaagatttccatccagattggctccttaaagaaaaaagatgcggtgcataatttattttactttcagttatctgctaacgcagctatgcaaaatgactcatttattggggagtgggtggtggcattaggtaaagtcttaccatattgtctattttgactgtttcattcttaatagaagtctacacattgcctgcaattgaggtataattttctttaaagggagtgttgtttcagataaggtagctgcgacctaagaaaggaataattctatatgattttaagtctttagggratggaagcactgtcttawtaattggaaagtcccaactgatagcactgacatawtcatgtgctttctttgcctgcctgctcatctgcagccctgatcacagaaggaagggagaagtagataagaaatagtagttatgaggatgaaacgtgcacatataggagccctctcacgttaggcttggtttggtgtctggaggcacgtgatgagaacagcagtggatctgtgggctcatgtttccttactcctgctctattaggactccagtctgaagggatgatctagtaccaaccaggagatgtttagaagamcgasatgtttcctgaagtattctgagctgtctcargttgattacgtgctttcttatcttagatggctcctggagagctgtctgggtaatatgctctcccactttggtaattttggattttttgcaratgctttttgtaaaagaacacctatgagtgaggcctatggttttggggtttgcagtgcccaaccagtcaagctggtctttgccttttttgtggttggatatggaaagagtggtcagtagatttcccagtgctgtactcatgccattcagctcatagtcacataggtttccatatttgctaataaaaataagaaaattccggaaaaggggagtangttgganttgtcaagttgaactgtgaatggtgtggatgagatattctggggagagaatggacagaccaggtttggcttagctactagttgagtgtcccttctagctctctgggatttctttctaatctgtaaaatcacctattttgttgaagtargcttgcctgtcctttcaattcttggacatttcagaacataagctatgtgtttttctggaaaaaaaaaaaggatatttgttagaattagaatttacttgttatgaatctaaccttcacacaccaaacccccagctaagacagtaagttgcatatataattgtaataaatactatgtaagtctgaaaggggaaagagaacttgagtttgcgacttttcttataatcttgaagaagtaattcccagacttcagagtgtgtaagaaatcactagaatgctagtttaaaaaggcatggattcctataccccagttacacagttcttatggcctgggatagagcctggaagtctgcatgtcacaggtgaaaaaaaaaaaaaaaaaaaaaaaaaaaaaaactcga

SEQ ID NO: 2093 - DNA, 1638 bp, Homo sapiens
  misc_feature (1578)..(1578): n equals a,t,g, or c
tttttttttctctcctctctaaacatttatgatgtatgatacagtgtgtcctggctggatttttcctgttagcaggcagaaagaatccctcctggattccagaataataaatacagtcatgtgctgcttaatgacgttttcgtcaacaatgggccacatatatgatggtccaaagcactatactgtacatcatctcattggaaaaccttatgaaataggagggcaactatcatcataatcatcttccttccccccaccaccaacttcagggagtgaggtcctgggaaatgaagggacactatccatgtgcttggatgtctctatcctggttccgtactctttccgctatgatatactgccttctatatatagataaaagttcaattytctttttcacaaatgagaggagaatatgattgagttttagtaaaattgatatccagtaatactataatgtatttagatcaagttagcacctaaatagcaaacctgcttgctctattaagctagtgatttttcactataggtgctaacaaccattacgtagcatctattctctaaaattgttgctatcggtctagcagaggagcagtgcactaatgtgggtgcagatattatagaaaccagaatacatgggtgatgactgttccactcaccatcttctcatatctctggggatctcattgtggagtaaggggcataatgttagtataccttttagagatcaaaggggcaagtcagcatcagctgaaagttgaatcacctcattaaagaattttatatccctttcagggggttgatttggaaaggaaaacagacataagatttgaatgtatcagtgtggctacttgtgaacatactgcattcaactaatggatagaaatttgaataaaatatttcagaagaggtttttcttgtgtgtgtgtgtttttaaaaagaattttgtaatgcacttcttccatgcatatcttatctactcttcagggaatacagaagcagatttacaaatgaagagacagtgtcattctgcttgagggtaatggtgggtgtcataatactctatgaccacgtacatccagtgggagcatttgctaaaacttccaaaattgatgtaagttattgttttatataaataatttcaaacgagtttctccatggaaaccataggattttattttatgataagagccagcaaaccggactctcacaaaactcagatttatagtttgtgaaatggtggactttcatctcctctgtccctgtgctgtttttcttgtggcctgtattcaggtggaatagaatgatcaaaggatgactatattgtctagtgagtacctcctggaaggcttctactacgtatttggcaatataaatagataattagatataaggaattttgagtcatatcctttaattcctttggccaaaggccatttcaaataaaatgtttatttcagaatgcatataaaaagtcagtagtgctgctgggcgtgctggctcatgcctgtagcccaagcactttggcaggctgaagcaggaggatcacttgagcccaggagtagaagaccagcctgggcngcatagtgagacccccatttctacaaaaaaaaaaaaaaaaaactcgagggggggcccgaa

SEQ ID NO: 2094 - DNA, 935 bp, Homo sapiens
gtggtggtggctgtaggacctggtgaataataaactgaaaaccactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactcagtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggagaaagcagagatggaggcagccagaagcatggtgcagtggtggggtttggtcattaatttgataatcacatggaatacaagctaatgtttattgagtacttactgcctgcccgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatattcaaaaaaaaaaaaaaaaaaaaaaaaaaaaaaaaaaaaa

SEQ ID NO: 2095 - DNA, 628 bp, Homo sapiens
ggcacgagcgggaggctgaggcaggagaatcgcttaaacctgggaggcggaggttgcagtgagctgatgagatcgtgtgccattgcactccagcctgggtgacagagcaagactccatctcaaaaaaagaaaagaaaaattttatatatgtaatttaacttgcaaatgacaagtttttaatattttcttatttttgcttgtgtttgtttatgcctttaattccttgaccagaatgactatagctaaattaactttggtagtgtattttcattcatttactatctcgtcatttccatgggtcaggagtctgggcacaccttagctgggtcctctgttgagagtctcaaaaaggctaaccagaaggtatcagccaaattgtatttatttctagaggttggagtgctcttccaagttcatggagttgttggcagaattcagttccttgcaactgtgggactgaggtagccattttcttgagggctaatggccagaaattgctctcagctccttagaggctattcacagttccttgccacgtggccttctcacagaccctctcagagcacagcagcttttacatcttcaagatcatcagcaggagatctgtctcctgctgcttctctcttac

SEQ ID NO: 2096 - DNA, 410 bp, Homo sapiens
gaattcggcacgagatgccttggtatttctccccttccctgttgtggtctctgtttcagtggtcggactcagaagcaggttctcgactatgttaaagaaggaggacataagaaggtgcagtttgaaaggtaagagaagcttcaatgctacttccagtctgagaaggctcagactcgccaggtaacagtttgttgctgctaaatatttctttacccagacttcagacttgatgtcccttgagttgtaaatgatagtctcagtcatcctcagcaagtccagtgttagagaggaaggttttagagcccaggggcacaccctcgagggggggcccggtacccaattcgccctatagtgagtcgtattacaattcactggccgtcgttttacaacgtcgtgactgggaaaaccct

SEQ ID NO: 2097 - DNA, 1409 bp, Homo sapiens
  misc_feature (478)..(478): n equals a,t,g, or c
gtcaggatatgagtcttcctatgtcattctttattctttcacatttatcatcttttatgatatgtacatatggcaaagattattcccactttacagatgaaggagcatttacttgaaaggatgcagaataaaaacagatataattcatatactaaaagacatttcatagacaatggcacaatgatttctccaaaccgccctacattatatgatttcttatcttcattgtgttgctgattaaacagtttaagtgatttatccagttcctcttaggaagtggcagaatagaaagctatgatggttaattttatgcgtcacttgactgagccatggggtgcccaacatttagtcaaacattattctgtgtgtatctgtgargatccttctggatgaaatcaacgtttgaattgttagactgaataaagcagatttctctccccaatgtatataggctcatcctatttgttaaaggtctganatgttgactctctmtcttagtccgttctatgttgctgtagagagatatgtgagactgggtaatttataaggaaaggtggtttatttggctcacagttctgcaggctgtgcaagaggcatggcacaagcatctgcttctggaaagggacgtcaggaggcttccaatcatggcagcaggggaaagggagaagggcaaggtatgtcacatggcaagagmggaagaaagagggagagaagaagaaggtgccaggctctttttamccatcagttatcatgggaactwatagagtgaggactcagcacaaagtcatgcataaaggatctgacccgtgatccaaacagtttccaccaggccccacctccagtgctggggatcaaaattcaacatgagatttgaagaggacaaatatccaaactatatcaccctcccataagtaagaaggcccctgtgagtgcagtgtgttttagtttaagctactaggaagggtgaggcaggaggattacttgttgagcctagaggttcaagtcctgcctaggcagcacagcaagaccccacctctaaaaaaatggagcccctcctgtcatagtacaccagatatttcctgtcttctaacttgaactgaaacatccatattttaaaagtctcaagtttacaaatcttgggactttttagcctccatatcacacaagccaatttcttataataataataatgatgatacaatatataggatatatattgtttctgtttcactaaagaaccctcatacagaagccaagcagcatcctctctaatgtcaaaatcagtgctttttctgtgacattcatgctcctctacgaatgaaaacctggctcacattttatgctaatactaaggagtaaaaaaacatccattacttattgtatacaataaaagcttcacaacaattgag

SEQ ID NO: 2098 - DNA, 1300 bp, Homo sapiens
gcacagaagtttgaaaagtaaccctgggaagaaatgaatgaggaggaaagaaaatgtacaaatgagaaggacccagtggatttgccatacaaagtacctctgagtaaaaccactaaattactcttggggttgtggggaattkagatgccactggccatttttgccttagttgaccttttttgggtcagtagtttctcaaacatcaatgtgcctaaggatcaccttgtgaagtgtttaagattcagagtcctgagccaccctgagagatctggattaaacagatcaaggaatctgcatttttaactagcactgccagtgagtttgtggactacactgagaaaatggctctacaatgttaaaagcacacatattttttaaaaatgacaaatgccatttcaaacagacttacaacccatttatataggctttccctgcaaagtacacagttttgacttataatcaagcctacaggaatgtaactagcaagggagcaaaggagagcaggagattagaagaagaatcaataaatggctcaaatatgtgaaataaccttgttcatccaaaatacaggatggtggtgttctaactgtcatggtagggttcaattgcctcagttcaattttaggaaaactggcaatcatttcttttgcaggggacacaatttctgaagaacccagtcctttaaaaaaaaaaaagtgagctatcaccccactattgagagagcagctactagctcagtattggtgtacccagatgggcagcctagcagccaaggaaacagaggtgggtctatgtactgtcccatcctgtcaccctttatcagtgagaccttgggcagagcctggctcatttcctggcatacgataggctttcctcatctgcacaatgaatatgcatccacatgttaaaccaccacttcgcaaattataaggttgaaatgagataataaagttgtgtccttagcatacagactggaccgttgagaagtgcagggggaaaaaatcagaaagatctgattttagatttttagtcaaactaagcaagaggacttaacatttcagcaactcagtttgcaccatgaatttctccactcaatttatgagaattactattcccttgaagtgatttaaggaatcattaagatttggcagtggaaggtgggactcatttcatataccattacccttaagccgagactactataagaagttggtacatggccaggcacggtgctcacgcctgtaatcccagcactttgggaggccaaggtgggtggatcacttgagttcaggagctcgag

SEQ ID NO: 2099 - DNA, 397 bp, Homo sapiens
ctcgtgccgattcggcagaggagatatcatctcacaccagttagaatggcgatcattaaaaagtcaggaaacaacaggtgctggagaggatgtggagaaataggaactgcaggttcactttcatwttaggattattgaggtataatgtacatgcaacacgtattactatgtctaatgtacatttcaatgagttttaacaaatttatattgtcatgtaataatcaccatgatcaatttacagaacgtttccacttgctgtagtttggatgtttgtcccccaaagtgcacgttgaaatttgatccccaatgttggaggtggggcttaatgggaggtgttggggttattggagtggatccctcaagaatgccttggtgccatcctcgaggggggggcccg

SEQ ID NO: 2100 - DNA, 964 bp, Homo sapiens
  misc_feature (883)..(883): n equals a,t,g, or c
ggctgaatgagttggctcaggattatcttgtccatgttgaaaactgcatttgaacccaggtctgtctgactccaaaaaccaaatggtttcctcctcatcatttcagaaactagcaaaatgcttttatgtacaccatttgattttagaatcctgtacattttctaaatgagggcagtgagactcagaaaaatagtatgtccaaagtgactaaggtagtagagagaagattcaaaaccctatcccaggccttctgactcccattccaatgctcttccagctacatcacagatcttttgagcaccccctgaaatcgcacccaaactgatgttcacgtggcagatacctcaccaccctctcctcacctcacgccttaaattctcatcttcaggcccctctgtctcaggtgacactcatgctggtaaaatgtcctgtgttttctgccggaagtagccagcccagacaggtgcaggagaggtctgctctagagggatatattgcacagccttgtccctgcctcccctatttcaccgctgatttctgatgggacccccagatgagtatcatccccctcctggccatttacaacctgcaaagcaacttgagttcctccagagggactggcagctctgtcaagaccatatacgattttcccatgaaaagtacctttggaagaagatttcttcatcagtttccaccatgaacacagatggacacgtttctccagaatcttctctgctgtcatttgctgtcctgcaaagaacctgggattgtccttcgctgggacagagagggtcaggcccaggctggaagttctcggttccactggtgctctcggggggaaaaatgtggtatttttccttttgtcttttctgcttttgttttncgctttgctccaagctgatgattctctcagcttctgtcttcatgatgccaacactaccaaatgaaaaaaaaaaaactcgag

SEQ ID NO: 2101 - DNA, 1004 bp, Homo sapiens
ggaattcggcacgaggcaaaataggcaatgtctcttttatcatagaaactatgtcctgattagaaaagatggaaagttcaaaataataattatgaagtgcataaaatagggtgtgttagtcaactatgccacagcagtgctgggtagcatacagccagtaactccacaacagcaagcatgtgtacctcatttatgcaactatggtttgtcctgggtttggctgatctaggctgggcttggctccaggccatatgtttagttcatgtctgttccttgcatctctcactcttctgggaccaacaggttacccagggcatgttaccctcatggccatggaagaactaaagtaggtgagcccaaccactctatcacatttcaaatctctgttcacttctacccactaatatcctgttggccaaaacgaatcatatggccaagcccaaaatcatgtggtagggaagtaaataccatccacaattggagcggggaggccatcaacacttgctgggcaataatccaaactgttatgcagaatgatgtgataaaagggatcagagagaagtgctgtgaggaatggggatgagttcactgggatgatgtcagagaggcaggcgagggccagatcttgctgagctacggaaagaaatggcacatttgatttgtgatttcaaataatccctttcactgctatgggaaaactggattgtaagttggcacgaagagcagatgcagggaagtcccagcaggtcggacactggttccagtgttcctaggtgggtggtgatagaaaggtgttgcactttgaatagtggcagtggagatgaaggcaagcgctagactgagaaacagaagcaaatggacagggtaccaaagtggataacatgtggtccctgaccttaaagagctaataacctacttgatgagaaaaagatgtacagacacagccatggtttggagagatatgtttttaaaataaggccatacacaaaaaaaaaaaaaaaaaa

SEQ ID NO: 2102 - DNA, 1110 bp, Homo sapiens
ggcacgagtgggtccaaaagcatgttgctcattctgttttttatacaggttactggctgtattagagagatggtctgggcttttaaaggcataactgaaaagggaatttcatactagttatggttaatgccagagtgctagaactagtgaagcctactgggagaaggtatgtttttctaaagaaagaattttggcctttaatgttacaacattcaaatttgcatctaaaactttcactctgggcaggttagaaagttaaagatattggtcaaatgattgggcaattcacctgttttcattaatctgtgttttgatccctatgatgtaaacaatattagtggatggattccaggattcttctgagagagggatatctttttgtttacagaaattatttgatgagagattaacataaaaaatgatgatttgaatgcctggatggctgtcccgaaagcaaccagagaaaatggttgataagaaaatcaagagatgcacttaagtttgacttgtttttgttttctcctgggaagatgaatagtgttgaaggattaaaaagatgatagaaaaaaagaaatgagagaggcattatgaaagaacccaagattggctgctgtaggatgagaacaatcactgggtacatgtaaataagaaatattatagagcgtagatatttctaataaagagtttaatctctctttctgttttgtgcaatatatgtcataaatctcatgcaaccctcatgtgattgatttattttcagaggccaatgctggtgaagaaactgaacattttataactggttagacatggtatggaacagagaaatccacactgaaaaagctgctcagaggagaagaaagagtaagtttaatgatcatatgcagaatttgagggctgtcaggctaccctttgatgtgacattcagctgggatacgtgggttattaaagttaacttgattgtaacaataactgataaaagctgctgtatcctcattcataggtagattatgtttataaagaacagtacctgatactactagatcagtttaaacatagttttgctattgttaagagaccaaagaattgctacattttgattggttgaatgca

SEQ ID NO: 2103 - DNA, 639 bp, Homo sapiens
attcggcacgggrttttwatatttcctgatctttgaaccaataaacacagaatacctactgtgtgtcaagtactatgctaggtgttgaaacaaagataaagtactatggaaactattaacacacacacacacgcacatgcacacatgcacaaacctatattcttttttcttaccaaaaccccaaatcatgctcctaattttgaatgtgcaggtgcggtttttgggtgattgggttctttctttgctatgtgggaggactccggtagagtagggtggttgtcagacagaagcagatgctcttatcagccgggcattctcaccccaggtagaagtgctgtctgtggtcgctcagcagatcctcagcatccaacaagccatcattcggaagctaaagacattcatctttgaagggactgagctctctctgaacccaacgcgcgctgtgttcatcaccatgaaccccgggtatgctggcagggctgaactgcccgacaatctcaaggtaaatgccagcagatatacatgtggggtgtgctttttagaatagaaacctctgggccgggtgtggcggctcacacctataatcccagcactttgggaggccaaggtgggcaaatcacctgaggtcaggagctcgag

SEQ ID NO: 2104 - DNA, 1197 bp, Homo sapiens
gagaaactttcccttcctgattctgtgcaagcacggctgtgagcgaacagcctccgtatttcaacaaacatcctacttgtatggtcttaggatctgtttccagacagtcacctcggggctcactctagtcctgaaagcatcttcccatccctttgtgatgttcagtctgttgcgggcattcccctctgacaggtgtccttgccctgctgcttctacagggtggcaaagagcaagggcttcagctcccaagctcagctgcagggcacttaggccccgagtgtgtccccagtgaccctgacttgagggacacactgggcgctgcagccacaaggcactgctcctgtagtcatggtgggcagccagcattgccccaggccacagtgctggtgtcccaggctcctcagggacctgaggacagggccaagtgtgccagtccacaccaggctggccctgccagtccacaccaggctggccctgccagtcaacaggtgcacatacaggtcctgaaaccacctcaggtcaaataagggatttgggggcacacaggttgcattctgcctcttgggaagatgatgcaagggaatgacaggcaggctggttccaacgcattgccaagcgccagctgagcgggctgggagcaggcacattccggtaaccaggacagaagtgggctagtgatacctggtcatgtcttttcccaagacaaaaccaggaagactggcccagcccgtttggtgtgttacaggctgaactgtgcccctccccaaatgtgtatggtgaaggcctaacctccagtacctccaaatgtgacctcacttggagagggggtgtttagagaggtaatcaggttaaaatgaagtcattagggtgggtcataaccccatacaactgctgccctgatatgaaggggaaatctggagacagctgtgtagaaaacaccatctgaacaggaagacagccatctacaggtcaaggggagaggtccgggaccgatcctccctcccagcccaaagcaggaactgaacctgacacctggattgtagacttctggcctccaggacagagacaatatgtgctgctgttgaagctgcccaggcagggttcctctgtgaggcagccccaggggactcagagtgtgccccaggagtcctgtgggaattgccccacccttcctggcacactcctgaatgttctcga

SEQ ID NO: 2105 - DNA, 421 bp, Homo sapiens
ggcacgtaggaactcctgacctcaggtaatccgcccgcctcagcctcccaaagtgctgggattacaggtgtgagccaccatgcccagcctaatctttattatttccttctttctgctagctgtggatttagtttgtccttctttttcttgttccttaaggtgtgcaggtaacttgtttctttgagatctttcttattttaatgtaagcatttccagctgtaagttccttcttagcactgcttttatagcagcccatattgtgtttttgtttttattggccatgttgtgtttttgttttgttttgttttgttttttaagacggagtctcgctctttcacccaggccggactgcagtggcgctatctcggctcactgcaagctccgccacccgggttcacaccattctcttgcctcagcctct

SEQ ID NO: 2106 - DNA, 1112 bp, Homo sapiens
ggcacgaggctccacccgggctgtttttatgacagctggcaaaacacgctaaggcacattgaggactcagtgaggcaggttcctgggcctctgttaggctaagtttgaagttgttccatcactgcctccctctgccttctttgccatttccatccatgatagcactaccctaactagtgatgagaagcagtctttggagttcctcttctctcctgtccctcatggctaatttccctgctcagacttctgcctctggtctctttccttctgtgcacactgacttttttccctctcctgtgccgagctggagggtaggaccctctgctgcagcactgggtcattctcaggataaagtcttggtctatctgggcgaacagatcacttccagctcgattcatacatagtgactcttgcttgaatagcaagatttgcccaaatcagagctttaatcctatatatatggaacaaataatcacttccagatctccagggaatctgctcacccttcataagtttactagacagtttcagaattttggaattgaatgtaagaattatgaagggagctgcccttcaacacgtggggatgatagattaaaggattatgaacttagccagtggaaggtgaagaagggtgtagtatagcggttggggtcacagggctgcttctagatgccaggtggcagcccgtttcttgccccaggtggtagggtagttgtgcatctctgttttgtgtacttttcaatgtttgttacctcacaatagaagaggtttaaaagactattttgtgagagatcaagttttaagtgctttttgcccccatcattggcttggctaggttagaacaaagtgtgataattgtatttcctttttttcttttctttccttcccttctttctctccctctctctcgttctccctacctcgctctttctttttataggaatggaaaacaaactctattcctataagcttctctatttctcctttttttccaaaatggaaaaaaaatagcaccagccacaagaggcctttgtggtgatgacatgctgtaatgaatgttaagttaaccacattacctgacacacaggctcagtacaggccgtcccatt

SEQ ID NO: 2107 - DNA, 418 bp, Homo sapiens
  misc_feature (80)..(80): n equals a,t,g, or c
tcggcacgaggttttatttcatgtattctttgtctatgtgtatatgtgtgttttatatgatttatatttatttatatttnatgtttacttacaaagttggaagccagacctggaaggacttcccctaccatactaaggaaatttaatttaattttgagtataaaggagaggtgctaaaggattttgatcaatgaagtgatagttctagtacccttacggaaagtggattagaggaggctaagaatgaaagcagggaagctggatgtggtggctcatgcccgtaatctcagcagctcgggaggcggaggtgggaggactgcttgagttcaggagtttgaggccagtctgggcaacatagcgagacctcatctctaaaaaaaagaaagaaagaaagaaaaaaaaaaaaaaaaaamtcgag

SEQ ID NO: 2108 - DNA, 759 bp, Homo sapiens
  misc_feature (740)..(740): n equals a,t,g, or c
ggaattcggcacgagtgtgtgccctrcattccaaggaatgggccaagggtttagatgaccctcatagataaggaatgaggctccaggctggccactcctggatttcttagcttggaactccaaaaccagcactcttcttagaccacagggccagtctcagggtatgtttaagttattgctgtcaggtgcatctgccatacactgtgtgtttgtgtgtgtgtggtgcagtgtggtgcatgtgcgtgtgtgtgtgtgtgatgtgctggagttgctgtgtgtgctgagtgggagagctcaacttcattccttgggtgacaagggagaagatactgatgggaggaggcgaatcacaggtttgcatttctgaaaatttagtctggagaaagacggacaggctatggggacatggagcaaagctacttcagtggtccaacaaagagatgatgagggtcagagtcagggacgcagctgggggaaaaacgtgaaaaatactttgtagataaaatggtcaggaccagatccttgcctttaactattcagtgcctgaatatatccttgatgacacagtagactgagaaaggaacaatctgcacaagaatgagaaccttggtsgggggttgtggcttacgcctgtaatccagcamtttggaagccgargcargtggatcacaaggtcagaaaatcaagaccatccttgccaatatsgtgaaaccgtgtctctactaaaaatacaataattngcctggtgtggtggtgggc

SEQ ID NO: 2109 - DNA, 1440 bp, Homo sapiens
ctacgtgccgtttagatgctgggccatatcactgagtgactatagttgattctcaaaacatccatgtgccaaatgattaatgaagtattaatatttatcaaatctactgatttatcaataacttgatttaaggaatatgcatctggaatatatcatatatgaatatgtacttttttactcagcagtaacttactattctttttctatttactgctccttcctactgggtctctctctcttgctctcgctctctctcgctctctgtctctctcttcttgaggtattttccctcctctttctattcaaagctttattttcagtctttgctttcttacagtgttgagttgtttctctgtattcctgtgtgcagattttgttatttttatataatttattcctttattctttgaagctgatctacccctgtctggctcccttttattgtgactagactctgggcagctttttattgacacagaaaccatttttttttccacacacccactcccactccatatcattcgtaccttttgaaggaggaatacacgtctgaaatagtacttctcacacagcacagcctggttcttgtcttgagccaagtctgtaacttggcttaagcagtttcctcattagataaaccctggctcttaaatgaaaaacaagcaacttcattcaatccccaaaacagcctgccgcagcacgaagagcagccacaccccagtggtgccagctttcttctcttttttttccatgtctgccctcttactagcttgcaccagttctgctgctgcatgatgttgtctgtggagtgatttttttaaaaagtatcagctgcttctttccatcctccttcatcatgtatttcctttaggagactttgttcctctaatccgttccaaaaagtaaaactattccaggctcattgcctcagggggagagtcaggccggtggaaaacaaggagggaatggaggaaatggtctcctcttaacacgttccattccagaagtccaggccctttcaggaaagccacgcgttactggcatgcatgaaacatttgggcgacaacctaaattagagcagtgcatcctcctgccatatccccttccccagctgaggagaggaggcagtttctgaagaacaaggaaggagagcatagattttcctaggctttgaggaagaagacctgcatcctgtttggctggactaattgtagggaggcttgtgggatctaaggagagaaggaatggctgtctcccttgctgagaagggtcacagggaggcagccagaacccagtgggcagcaacgacttcatagtgtggctgaacagcgagggctccagacagctcttccagaggccttggtgtccccaaggccctgatacagtagagagagccactgaaccaagggggcccatgcagacaggcacatagggagcccc

SEQ ID NO: 2110 - DNA, 961 bp, Homo sapiens
  misc_feature (549)..(549): n equals a,t,g, or c
gtcaatggctgtccatgtcgcccgtgcttcacctgaggaggctggcgaggtgtatcctctttcacctgcctcagttttcctcatctgtgaaacggcctcatggctttggagcaaacagaatgacagataaaagggacaaatgacacagggctctccatttgtttaacgagtacttattgagaacctactgtgtgcagggcaccaagccaggctgtggagaaaacagaagcgggtgacaggatgggagaggttccagaagccgctaggaggagaaggcagttaagctgtgacctggggcaggtggatgggcctccctgggaagatctgggtgtgggaagcgcctgccaggcagggggcacctcaagtgcaaaggccctgargtgtggacaggcgagacaagaccaggacaagccccgctgttkccgttgtctggaaaccaaggtacaaagagaggaggggacggagccaaggccacgcagctggcagagktggagctgggatgttaggggaggaacagaggtcacgacctctgcaagcttcatcccccanccctcacccctcacccccagccagaatcttccagaggggtggcctccccttcctgagccaccccagctgttgcggaggctgctgctgtcctggttcccttgtttaattacaaacaacatttttcgccctcacttaattatgcaacagacgcccgtggatctgccaccatctggccccactttctggcttgagacgacgagtcgcagtgacttcgagggctgagaggggagcaagcgggaggcacctcggccaggagggcaccgagcttggcatggcctcagctctgtgatgtacctggccacatctctgagtcctcatctgcagaattgggacaattgagggtggcgcaagggtctgtgagacaagagctgcttggcaaagaggagccctcagccctaaagggggcctcgag

SEQ ID NO: 2111 - DNA, 1174 bp, Homo sapiens
cgagaaggattgttttttgttgacttagcaaaaacttctccttacaaaacctcttgagtgtgctgaattgtgaacaggaaattgacttggggtaaggggagagagggaaccagggcactcttaaagagaaaaagacccctgggtcgataaccaagtggtcctgggactggatctggctattacatgcacatcaacaatcttatgtacttgctgattaacaaattatatatattctgcatgtttacacaaacagttcttgtgctagagagtccacatcatttaaactttgtgggagaattttgcaaatgatccaatcctagaggcttgtactctttcttgagccccactcacctttcctttgtacctcaaacctcagtctgactcttccagaaatataggggatggttcccttctcttctcccattccctacataaccctgagtttaaatacaaacactcagtttaattgtttcataaggcttatttttggataaagatatttcattttccctgcacattaaacttttatcacacttactgataaaatgccacagctcttgtattatcaactacaagttcagtcttctactcagataccaattaatttctgtttctttgagtatcatggactgaattttgtcccccactcattcatgtgttgaagacctaacccacaatgtgtttatatttgacatagggcctttaaggaagtaattaatgttaaataaggccataagggtggagccctaatccaacaggattagcattcttgtaagaagaggaaggggcaccagagttttcaagcacacaagaaaggccatgtgaggagccacataaccacggctgtctgcctggcgtcgtggcacacacctgtaatcccagcactttgggaggccaaagtaggcagatcgcttgaggtaaggagttcaagaccagcttgggcaacatagcgagacccatctctagaaaaaatacaaaaattagcagggtatggtggcaggcacctatagtcctagctgttgtaggggctgtggtgggaggatcgcttgaacctgggaggcagaggttgtcagtgggctggaatcaggccatcgcactccagcctgggtgacagagagagaccctgtcttaaaaaaaaaaaaaaaaaaaaaaaaaaaaaaaaaaaaaactcgta

SEQ ID NO: 2112 - DNA, 1939 bp, Homo sapiens
  misc_feature (1874)..(1874): n equals a,t,g, or c
agtaaaataaataaaaatagaaaaaaaaactcttcagtcaaatatggtggccactagtggctattgagtacttgaaatgtagctagttagaactgcaatgtgctgtaagcctaaaatacacacatttagtacaaaaaagattataaaatatcccaacttttatattgattttgaaataatattttgagtatattgggctaaacaaaatgtagcattaaaattaatctcacttctttcaatgtggctgacaaaaaagtttaaattaaatgtgcggctcacattttgtttctattggacagcacaggtggagaaggtctctgaacataaaacaccgawtaagtatattttccactgggactgggggtgggtgctttgggggaagtgcataggtgctgggcagtgttaaaatcagggtgggcgtaggtggcagtgaagggcagtctttgtgcagccagatggcaagtgagagcatgaatgcctgactgttggaaatgacaaaataaatcatggaatcctgaagtttcagggtgtaaaatgctttagaaatcatcatctgacccaataaatgatggaaagaaatgccctggactcggaatctgaatgttttggttccagtctcagctccatcatttattagataggacgtcttgggcaagtcagtctcttttcttatatgtctaatgggggacataaaatctgcttgatctttcctggaaggttatttctattattttaacttatttgaaagcccactcaaaattccaaagtactgcaacaatatgagatattaaatagatgttgcctattttacaatcctggctcagcccagttctacagacagttggtaattttcaaggtgagtaattaatacagagatactttggcagtgaaaatattattagtgtgtttgtgcttatgtctacacagagaagagagaggaggcaaagataaaacctgtagctcccattttcttcttatatatttttacttattttttctgtcacagttataaccccttaagaaaaatttagatgagtactagaatctggcaaaattagttaaatcagactgagatgaataagatagaacaaaatgagctgtagaatgatgttttggctgagccactcactctgccagggtcagcaccttctttaattgactcttttcaaggaaatgcagtacaggttgctctctgttgttacctgtgtgtcatgacccgctgggccattaacccatttgtcttgaatagtcaattctctggccccaggattgtcaggagccaggaggagctggggaacatggctgagacattctcactcctgttccagcctcaggaaaacccactgagcctgggtcaaatcttgggagtaactgctgacaatggtgattcctgagccatcctctctccattgcttgtcctgggtgaggcctcagggaggccaacaatttcctatgcctctctattgctgtacacatctggaactgaaattcattgcatatcccttcacccctgaatttaaccctgagaagtgtgaaaaattggttcaaacgtcctcatcaaaactcatgttgaaatttaattatcatatgtaatggtattggaagatggaaactttaatagatgataggggccagggtgcagtgctcacgcctgtaatcccaggactttgggaggctgaggcaagaggatcacttgagcacaggagtttgagatcagcctgggcaacatggtaagatcctgtctctaaaaaaaaaacacatacaaattagtggggagtggtggcacacacctgtagtcccagctattctagagtcgaggtaagaggttcacctgagcctagagaggttgaggctgcaatgagctgtaattgcanccactgcgctccagcgtggacaacagagggagaccctgtctcaaaaaaaaaaaaaaaaactcgag

SEQ ID NO: 2113 - DNA, 731 bp, Homo sapiens
ggcacgagacctggggttgtcggtgctgctccaggatgtcagatgctcccctgggggtgtgggtgctgctccaggctgtcagatgctcgcctgggtgtgtgggcactgctcctgactctccgatgctcacctgtggttgtgggtgctgctccagaccatcagatgctcacctgggtgtgtgggtgctgctccaggttgtcaggtgctcaccatgggctatgggtgctgctacctgttgtcagatgctcacctcggggtgtgggcactgctccgggctgtcagatgctcgcctgtggctgtgggcgctgctctagactctacgatgctcacctgtggttgtgggtgctgctccagacaatcagatgctcacttggggttgtgggtgctgctccaggtcatcggatgctcgcctgggagtgtggttgctgctccaggctgtcggatgctcacctgggggtgcagggtgctgttccaggctgtcagatgctcccctgggggtgtgggtgctgctccgggctgtcagattctcacctgtgcgtgtgggtgctgctgcgggctgtcagatgctcacctggggttgtgggtgctgttaaaggctgtcagatgctcgcctggggttgtgggtgctgctccgttcggtcagatgctcgcctgggggcgtgtgtgctgctccatgggttcagatgctcgcctggaggtatgggtcctgctccgggaggtcagatgctcac

SEQ ID NO: 2114 - DNA, 1374 bp, Homo sapiens
  misc_feature (642)..(642): n equals a,t,g, or c
ggcacgagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccactctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatgggggggcggggcaagagcaggcattgctgaanttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacgtgtgggcctgggagagcccagccctgctctggcccgcccccgtctcgccatctgtggaacttttggtttcaagcagctgcaagagttgccaaaaggttgaaagaattcagctgcctgactccaggtcctggcatccccaggagaggcccctctttcccaggggctctggtcaaagttccagagcctggcatccccaggagaagagctcctctttcccagagctctgctcaaagtcccagggagccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacc

SEQ ID NO: 2115 - DNA, 1000 bp, Homo sapiens
ggcacgagtgttcaagacattttttttcttttctttaattttcagaagtttgactatgatgtgtgttggtaaggatttcttttggtttctcctatttgggtttgctcagattcttgagtctgtaggtttacatcttttgccaaatttgaaaagttttctgtcattattcctttgagtatattttcagtcccaccctcttttgtaactctttctggaactccaatgacaagcgcattagatcttttgttatggttccacagatccctgagcatcaattcattttttctcattagacttaaatagactttcaagggactcaaaacagagtctactttctctcttttgtttagactgggcagaataatggcctccgaaagatgtccacatcctaatctctggaacctgtgaatatgttaccttatacagcaaaaggacttggttgacatgattacattaagaaccttgtgatgaggagattattctggattataatgggcccaatgtaatcacaagggtccttagaaatggaagagagttagaaggagatatgactatggaggaggttggagtaatgtgatgtgagaaggattcgatcctctgttgctggctttgaggatgatagaaggggactacaagccaaggaatgtgggctgcctccagaagctaaaaaaacaatgaaaaggattctttcctggtgtctccagaaaagaatacagcccttccaacaccttgattttagcacttctgacctacagaactgtaagataaaaaatgtgtaatactttaagcttctaaatttgaggtaatttgttgtgagaacaataagaaacaaacacaggaatccctattgtctgtcttcaagttcactgattcttttcttttcttttttttttttgaggtggagtctcactctgttgccccagctggagtgcagtggtgcgatctcagctcactgcaaactctgcctcccgggttcatgccattctcctgcctcagcctc

SEQ ID NO: 2116 - DNA, 1122 bp, Homo sapiens
ggcacgagtgaaagcctagaggtaatgacatgctcggcgagctcaaactcctggaaactctcccaggaaaactcgggatgcgaagatgtactctagaagggaacagatggcttctgtttttgtgtgtggtatggaatggatggcaaaaggtcagtgagctctgtgggagacagcacggtgccaaggggaccgtgtcaccttcctcacctctgcctctgtctcagacacctgctgacatatgaccaggtgcagatggagcagtgccagccacgccctgggatgaggagatcaagctggtgctcagccccagcaaggcggggtcagtgacatccctatatgtgaatggggacacatttgtaagcagagacatgaagtgacagaatgagatcacccacagcgacatctgccactacccaggtgactgggccaaaagtgggctgtggaattggaacaaaatacaacagattgtatttagatattgactccattctaatatatagactttgcaaggtaaacatttcaaaattgctctttactatgagaaccaaatgttttctccagatattttgatataaatttttgatgaaataaatgcatcctaggaaaggccttgctcccatattaggaaagtaaattctatatccaaggacactgggtaactacagccttgaatgttcatgggctacaataacgacgattatgagggaaccagatctctctcctttactgtgtttgggtagatcctttcatcagtatgtcaaggctactgaaatgttagtgtaatcttgatgtcagacaggggacagggtctttgcttggaagcctcccaaatccagggcctgtggaaagccaaagcattccctctgagatttcggcgaaatcttttgtctcctaattcccctttcttttttctttttctagttttttgttttttttttttttaggcggagtttcgctcttgttgcccaggctggagtgcaatggctcaatctcggctcaccacaacctccgcctcccaggttcaaatgattctcctgcctcagcctcccaggtagctgggattgcaggcatgcaccaccatgcccggcaacaagagcgaaatccgcctaaaaaaaaaaaaaa

SEQ ID NO: 2117 - DNA, 996 bp, Homo sapiens
  misc_feature (190)..(190): n equals a,t,g, or c
  misc_feature (985)..(985): n equals a,t,g, or c
ttcctttgccctggaaaagtttcaccacctttatatttttaccccagccttggagttatctttttctgctctccattctccatgtccaaaaacttgctgtcagtccagtttttaatcagttttctccttgaggcttgatctcccatttctctcatcccattatagcttttcatgtagatctgaggcccangttactgtaattcttttttttccaatttccttgctcccaggatccccatcttgtataaagtttctaaggtgctcctcctcaaactccatttttacaatatccgtattgtaaaattttcattttcagtaacacccagtagataatttttcaaagacgatcctcctcaaacacccatttttacaatatctctattgtaaaatttcattttcactaagtaacacccagtagataattcctatggagcagtggtgttccaaattctccattacctctatgcctaatattcatcagccttcattactctctagcatattcaccttgattcaacagattcaaacttcctacagccttctactgatgtcttataagctcttgcctctgtgcctttctcatgctattctttttgcttagattgctctttggtcccagctcatgttcatcactcccttcaaagcctttcttcctttatatcttctgactgagctctccctgattgacatcacctcatgcgatgacctccctcattctgtgctgcctcagcacttatcttttgagtttgtactgtggtccatgtacttactaatatgttgctttgtaattattttctagcactctgtgttacagtttcatatttgtatttatttccaaaattaaattgtaagctccttgagggcaggaataataacttttacatttgtatctctgcacccccgagtgcctagtatagtgctgagcacatagtaggcgtttaataaatgcttgttgaagtaaaaaaaaaaaaaaaaaaaaacgggncgggggggggg

SEQ ID NO: 2118 - DNA, 2111 bp, Homo sapiens
gaattcggcacgaggstttccatctctgagttggccttcaacgttcaagaaaatggatatattattttttttccttttctatttccttcaggaaagactaggtttcagtacggtttcaaataaaagcagtggagtaattttctttcccgtagttctccctcagccccctgaatcataagaatcaaccctcattccttttctcccaacctctcaggtgcatttgctgagtcactgcatgttggcctgaaacagggtccatgtgtctccccaccatttccaaggcatggaggtgggaagtgggaagtggggagggtgagctttggactgaacacccaaggsccacggccaccagctacgaggcttcccacaggcttgtctttctctgwatgtctgtcacaggattccagttctccagtcaaatcaatgatgcttctttggccctgtgctccctgaagtcctccctttatatcataagtaaccaaggagtccttcatgcctgatttttgaatgctagtaaattttcaacatcctcatccaactctattccccaggcttccctgctccaaactccaaatcacctgaaaaatatgttccagtcaccccacctctgcaccaacttgagtgagtctgaactgagaagcatttattccaatttgtcatatttgtggaggatttttcttaaatggtcacaatatttctagttccatgggctcttccaaggctttgtcacttcccatccagargcagtttctgtgttcttccccttgaacgtgggargcatttgtgacggctgccttgamcaacagggtggaagagacactgcatgamctctgagtgagtaaaggccaggcagcccttgcttgactctcttccttgagatgtcatccttagaacctccatgttgtgagaaagctcaggccactgggaagaacacgtgggtgttcccattgttgacagcctacagacaatatcaaacaccagacatgtgaatgaatgagcctccaggtaggtccagccattgagccagccctcagtcaactgtaccagctgtgaccccagacatattggggtagagacaattatwatatctctactctgccttgttcctgttgctgacccacaatcttgtgagtctactgctgggtcatgaaaaaaaacaaattgaactttcattcatwcattcattcattcattcatctatccacctactcatccatccaccaaagacacacttactgatatcccactgtgtatcatagactataagcatgggggctgcagagataaagaaagaagtgaaggtcctgaggagctcacagacatactactcattctgctgttgacccatcaccccaagtaacaaaagagcacccctcctaatatcctgcttcagattttcacagtcgctcatttatgcttgcatttctgctttgccattccaactaagtgcctttagaataagggatcaactttttttctcatggtgcttagcacggttttataaatttaacacatgtttgatatagcttgttaatttttgaaaaatcagtccatatactgctagaggttttcaaggcttcaagtaaataaaagaattacattttggaaaaataacttaataaatgaaatccttgtgccaaaaggagaaaaagaagaaaggtatgaatgatttttgggtccttattagatgactggggcctgctatttcatttactcttcatagcaaacttatacaaattatgacaatcctcaaattgcagactttaagataaactggctaaattgaatgactatcaaatgtggcacaaggagattagccaatgccagggactcttttgcagccactgtggtgactccagcacatgaagatgccacccagatgacatttgctttcaagacctttgaacaggctgccttgaaaagaatgctttccaatgtgcaactctatatcttctgtggctctggtaagtgaggactttacagcttatgttcactctttcctgtaatcatttccaggcctcgtggaaaagtgttaccaattaatactcccattatagaactggaacaaaacaaagtgcaggacgtgggacaaatcagttaaatatcctcga

SEQ ID NO: 2119 - DNA, 473 bp, Homo sapiens
gaattcggcacgrgcaatccacccatcttggcctcccaaatttctgggattacaggtgtgagccaccatgcccagcacatttctttttataattacccaatctgtggtattctgttacagcaacagaaaatgaaccaagwsgtatgttctctttggtatctgctgcttttattcaacattaggtttataaaattcatcaacattgatgtgcatagcaatagttcattcactctcattgccttatgggaccccgctgtatgagccatctatctattgtatctatggctgtggracaaactaccccaaaacctagtgacttaaaacaakaacatttatcttgcatagtttctatgcattaggaatttcaagagcagcctagctgggcagttctggctcagggcctctcatgtggttgcagctgagatgtccttcagggctgcagacatctgactggggcttgaccgttgctcgag

SEQ ID NO: 2120 - DNA, 1478 bp, Homo sapiens
ggcacgagttacactagataaacctgtattttaaaagtattcaaacaaaacacaacacacttacttagagcaataataataaatattacagaataatataatccttcccgttctaaaatatttttaaagaatatgataactttatattgggtcctagataccatactgtatttagggaatttaccaagatagagctggctttattgtaagtcaagcaaaatgaactggcgttcttgtaagctgggttcagtctactattatcggttctgtacagtgtctcctcgtgtgctagtgaaacaggatggggggcgaggaacctccttcccatcttttactagcctgagaagtatcttttcaatattttataattttgcctttggcaaagggctgcttatctcctgggaattcaggcacattttgaagatttccccatagccaatgagcacagaatgattattctcacaaaagttcttaagaaatgtcacctctcttgtgtctccttctttctagataagctctccccacacctttctcctgagacagtctagaatctcccttttatattgctgcagaaacacagactcatttccatacacgtttactccggcacctatagcatagatcaatgctatggacacgtgctgttgtgtgagatttaaaagtaaattttccattcagagatttttaaaaaaaaaaatctggtcatagcagccattagtcaacttagtcttcattgccctcctttttatttctaagcatgattcattcaggatataagattgcatgggcaatcattctagtattaaacaccttggaaagatgaggaccatcttcttcctccctgtgtctgcttctctttctgttccatcttctttccttccccatttctttcactctttccttccctgtccaggtcctgttgaatgctgactcaggccatctgtgctttccaggccagctctttcacttattgctcatgattttggccaagccatttaaaatgcctaggcctcaatttcctcatgggtaaaggaagctaataaggtctacctaatggacccacccaataaaattcttttgagaattaagtgggaaaatgtatattaaacacattggaaattcttgtctacaggggatatgtcatcaatgggagttgttactgctgctgtttctactagattccaaattgagaagaaaatctttctaaagcaagtatcaagtagagtcaggaggaagcatctaaagtttctgcaaggaccatggcacatcttcttgaacactgctgggatgattatttggataataggagttggcaccattttcattattttataggcaatatagaaatatatctgcactcttctttaaaaaaattactaatacataatagttgtatatttttatggggtacaagtgatattttgctacctgcatagaaagtgtaatgatcaagtcagaatgttaaggttgtccatcac

SEQ ID NO: 2121 - DNA, 601 bp, Homo sapiens
  misc_feature (7)..(7): n equals a,t,g, or c
  misc_feature (292)..(292): n equals a,t,g, or c
aggaatncggcmcgagcagatagagaaactgaggtccagacagggaagggactagccctggggccccacagtgccttttggtgagaccccaggccaggcctggagagagacaggcacacacacactaactagtaattcccactcaacagatcaacagattcctcttgcaggaacaagaggaatttcgtttcccttccaccaacaaatcaaagatcwgttatggtttcatgctaaccgccactgakgcttggttggcttttctctcttgcttatcacagtgacatctgcagantaccctgggcattctgtagaaagtgtgcactgcctggggtgggagttgatgggggttaggattaggtagaccccctctgtgctcccacaatctcctgaggaccctgagccccagtcctgaccacatcctcctccagccattcttgatgtgtctccctgctcaattgggacttcttgagcacagggacccttgtacggaattatctttatgtgactgtcacatatcttggaggtgaacttctggagagggggtcagagggagaggcctgggtgagttgtgctgccttccgtcatccccctcagtctcgag

SEQ ID NO: 2122 - DNA, 1120 bp, Homo sapiens
  misc_feature (994)..(994): n equals a,t,g, or c
  misc_feature (1045)..(1045): n equals a,t,g, or c
  misc_feature (1049)..(1049): n equals a,t,g, or c
gttgcagaatttgggcacgaggctccccatgccaggttcctgcttctcatggtccttctcacggttgttgggagttttcctatctctccagtgctcttggaagacggtttatggtatattatcaagggaagcctgaaagggaaactgctagttgtgttcaccacccaacgagatctggagtcctgccttctttctacacttagtcacacagacctagccccacagccctctagttgcagggcttgattgagaaaagtatgcagaggccgagagtgtgtgtgaccgaccacatcatagccatcgaatgtttatcaattcccattcagtgtttcagtgaatcttcagtagtctctgtgttctttgttagtcacctggtttagatgttccatgaattgttcttcctcttctagcaatgatgaccaacgtctatgaattgttaatatttaccggggactgtgctaagtgctttgcatgtgtatttttcatttggtgttcgctataactaggagtaggttgttttgctcctttcacagaggaggaaacaggcttggaaaaggtcactggcatgcataaatcccaagctagtcagtagcagagctagtcggtagcagaactagtccgtagcagagctagtcggtagcagacctagccggtagcagtgctagtcggtggcagagctagcctttgaattgaggtttttctgactccagattccatgccttaaactgacttcctgaatgtatccactgggataaatttctcaaaatggaattggtagatcagatgatatatgagtttaaaatatggatagatagttccaaccggtttttcagggcattgcctggtgtttaccattcttgkgtatgtgcttatttgcaccascagtatttatcttttagttttgcttttaaaaacaaatcttgtaggccaggtgcggtggctcacgcctgtaatcccagcattttgggargccgargtgggaggattgcctgancccaggagtttgaaactggsttgggcaacatagcgaggcccaatctcccanatanataaatgatatttttaaaaacaaaataacacagagcccttggaaatcaaaaatctagcaggaggaaaaaac

SEQ ID NO: 2123 - DNA, 755 bp, Homo sapiens
  misc_feature (512)..(512): n equals a,t,g, or c
gattttctgtaaattaaagttgtttttactaaattatgggccatattttttggatgtgtgctctgaaactaatactgcttgcaaggagaaaaaaaggagatgcaagtgtgtctaatatattggatacataaaagctggagtatgcataatcgtcttgcaagagttcttaaatctctgtatataaactgtttaaaagtaaattaaaattattccttaatgaaatacaaatctgaagtcacttgaataactaatcattttatgacccatgcagtgaatttttaatgcctacttctacctgattattttagatatgtctgtgttgtaaattaaaagctacataaatcattaatgtgttgatacagatcagtgaactgcttacactatatgtgattccttaggacatacaatgtctgattcacctccctccctttcaattatatggctgccaggctctttttctctattcattttttgcaaggtcttatttggtagaactgcattccagggtcttnatcactttcccaagaggaactgatgtttccaatcaaaagagggctcacactgcaaaaatgaacaggtcctaaatccaagagtgtgaacacacaatctacgagggagaagtttgcttttatttttgtttttgttttagtaatctatgctcccaagaaactgtagcaacgaaacataacctctgcacttttttaggtcattgcagcctttttaccttccttgaaaatgtcgtgccctttctgtac

SEQ ID NO: 2124 - DNA, 2388 bp, Homo sapiens
acgaggtagaaaccttgaaattttagaaaacatcaatttcatgcctaatgttttgcctggtataattgttgagcccagagactgtttgtacttgaacagttcaggaagaaaagaagtagaaatgatttttgttgctgccacacttcctacttttttgtatgagcttaaacctatgtcttgaacatttatatcaccattcttgcccctgaacacaaatgaattttttatctttattttatgctacatttctatacaattaaatttatattttcaattgtttgtttgcttgctcccattgggagtcgttaaagtgtaaacagggcatagggactgcaattaaccttgagaacaaaagaacaatttatcactttaccaaacaacaaaattcactcttattgttaataattcataataaaggcagcaactatcaattaagttgagaacagaagtggcaaaacaggcacagtcatcaaatttgcaatagctaactgctctattctgaattatcagcagtagctgagaactacccaaaggtttgctgatggccacagtacagaacgattagtgaattcacggctgcatgtctggtttgctctatttcccaaactgagtaaataaatgagagcttgctaatcaggactattaggggttgctaggaaataaaaaatttgctactatgggctgtctccaacctagcaaggagtttgacacaaaacttctattacacacggttaactagcacttaaaacaaatatatctataagaatttatcagtactggtctgattcgtaggctaccccaaaaccctgcctagccaatgaagtagctggaatagaaggaaaggtaactgttgccaactgattgaacaactttttggttctttttatttgtaacagtgtacccccaaaatctgaggtgtttgagggttacctccctctgccaaacacctagacatttactgaacagacttttactacgaagtgttaatggaagtcagggaccccaaatggagggactggctgaagccatggcagaagaacataaattgtgaagatttcatggacatttattagttccccaaattaatacttttataattttttacatctatctttactgcaatctctgaacataaattgtgaagatttcatggacatttatcacttccctaatcaatactcttgtgatttcctatgcctgtctttactttaatctcttaatcctgtcatcttcataagctgaggatgtatgtcaccataggaccctgtgatgattgtgttaactgcacaaattgttcataactcatgtgtgtttaaacaatatgaaatctgggcaccttgaaaaaagaacaggataacagctatgttcagggaacaagggagataaccattaggtctggctgcctgagagccaggcagaacagaaccatatttctcttctttcaaagcaataggagaaatatcgctgaattctttttctcagcaaagaacagcctggagaaagagagtgtgttcctagcaggaggtctctgaaatggctgctctgggaatgtctgtcttatacggatgtagataagggatgaaataagccccagtctcccgtagtgctcccaggcttattaggatgaggacattcccacctaataaattttggtcagaccagttgtctgctctcaaaccctgtctcctgataagatgttatcaatgacgatgcgtgcccagtggaacatgcaacttcattagcatttttaatttcaccccagtcctgtgatctcgccctgcctccatttgccttgtgatattttattaccttatgaagcatgtgatctctgtgacccgacccctttcctgcttttctggagggtaaggacccctgaaccccttgcctccacggcacgagctcgtgccgttttttcctgtttttggattttatgtaaataaacagagtcataaatttgacactctcaaaatatcccccatcagattcatgtaagacttttattttggtgatacttctccacaaccatcgcactacaacttaccttaatccactcaactaacacttacatatttggctttagagatgtatatcaatatcttctgtggtctggagataattcttatcatattagcaccttagatgtaattgccagtattcatgatatgttaaaaaattattaaatgtctactaaatttgctacagcttagctacttcacgagactctaaaattcggttccctgctatactcttaaatttcaaatataaacatatatacctcttcccttgataaaatcttacttccgatctgtatcttttcttgacactttccttctcttgacacttttggttgactgggtctgtatgttgaaatgtctgccttgatagata

SEQ ID NO: 2125 - DNA, 1245 bp, Homo sapiens
gaattcggcacgagtgcttccaggtaagagccagctgtggtaaaagcagatgggtatgtacttgatctttgtttactgtgtggtactcttttttgtttcagccctgacgggggtggctggtggagctcctagtgaaatgcactgaagtctctgcaggggggctgcactagctccaagtcttagacaggcagaaatgtgatctctttccctgtcacactcctgtactggggctcataactctccatgcagatgcacactgtcgtctgtctccaggccatagtgtgattgagaaccgcagaagacacctctcccctggctctccactggagtggtttcacgctggaactcctcactcagcccaatacagacagctctgtggctttcctgttctccaatgtggtaatgctgctgattgaagcagagagggagaggggctccatcttttggcacatgcaggtgggtgtcagctgtggtgctgtcagctggctgggtcagcctaagctcagacccgatggacctaatagacatttacagattattctacccaacaactgcagaatatgtatttctcatctgcacgtggaacattcccccaaattgaccatatgcttggccagaaagcaagtctcaatacattcaaaaaaattgaaatcatatcaagtatcttctcagaccacagtggaataaaattagaaatcaataccaagaggaaaaaataaggagtttttcaataggtagaggaaggagaatggtgccctggggttaagaacacattaacaaaagtacaagaggcatgaaaatgcagtgtgtaaaggaagagaaaagttaatgatgcaccttcatggtaaaggggtacaaagccggaggtagtggactggacgaggcaaacctccaagcccagagcctgtaaatggcctgctcgatggtgtatgggaagcctcaggcagtaacagctgagttggtggcagaatacgcaggtggtgggaaccccagggttgatcacagacctgtcagcatgggctctyagaagggctycagctggcagctgaaacggttgggtgggarcagggtggccgtgctgstgktctttygctgaggaaggcggactyccttagctggagcaagggaggctggcagctgtgggatgcgtggcccgattgcacttcccttttataggagtggaggtgtatttcgctgttggggacatgcaaacgtgctcagcctccccctctctccctggctcga

SEQ ID NO: 2126 - DNA, 431 bp, Homo sapiens
ggcacgaggtgaattgtcttctccacatatccattagcagagtgcatgttcggtaccaaagggtggtgtgatgcaagctctctttcctgctgctctcgtagtttcctgtgttgctgtgaaatagaaggtgggataaggcactttggttctccaggagtactttcctctaactgccaccgtttttaagcttctcagcagtgtttttcacaccctgctttccgtgtgcatgtcttgtcacttatgattaaactaaacacaagtttttccatttttaatgctgctatgcttctatacctctggtaagtttgatcatcgtgttctgggttgggagggtgagagttcttgtgattccctttgtacttccctgacactaacacatgccctgcacacccatcatgttgcatcagtgtccatggtggtggtataaaatt

SEQ ID NO: 2127 - DNA, 1011 bp, Homo sapiens
  misc_feature (863)..(863): n equals a,t,g, or c
gattcaaaatgcatggcccagctgctcctcatattgaagttgcgaccatgggatttggcaacattgagctccggctctgggcattgctctcacagctgagagtgacgcccaggctctggcagcccagacttgtcatcctgtaaatgaacaatccccagtccccgggcctcattttattcacttggctgagctgcctgtttgctttccgttctgtgctcgccagctcactaagcaagaggatccgtgcctgactgcgtggagaagctgtagaggaaatggccaccctgactgtcccagcacctmccggggtggcccggggcctgggscctgagcagaactgtgataaagggaagcagggaagcagtgcgagarccctgaccaggtgcargagcctgattccgaatccamctctgccatgggcagattgcatgatgccatcagagccctctaamctctggccttcagttgtcacacctgtaaaatggggaaatattctagagaagtggstcaaaacctgatcatccatcagcytccccccaagaacatggggacagtgcacatggcaaggccccatgcccagagtttctgattccacagtttgggatgaagcctaagaatgcgcatttccaacaaggcttctggtgaggctgatggcccagggacctcactttgggaagctctgtagtaaatccagtttctcagccagtctgctctgtagagctcctgagacagactctttccctaggcctcccctgaggttcttacttaagcaagtctccatttttcaaaagctctgccaggtaactctatatggcactagggctgagaggcacttggtggatgtttctaagatcccacgtagntctcacatgccaggatgccatgattttgaagcagagtgcctcctgccttgccaaggctgacagcacacacagggcaaaacgccatcgtcacatattggaatttcactctttgaaaacctggtaatcgtgtgtcccatttcagctcgag

SEQ ID NO: 2128 - DNA, 569 bp, Homo sapiens
attcggcacgaggacttattkgggctaatcagcctaaagaggatgatgcatataatatgcataggagagatctctctgtctgtgtctgtctctgtctctgtccctctctctccctttctctttgcaaaacacgcattcactgttgccgtgaactgccacagatagctccatagtgaaactgaggctgaaaagggtagagtaggggcacaaagtgagccgtggctcttcatggcatcactcagactcagctgccttgagccagctccacccccgactcccaggtattcaacataataaatttggtggtgttgttttgttttgttttgtttttgtttttgtttgcttttttttgagatgtagtctcactctgtagcccaagctggagtgcagtggcatgattcggctcactgcaaccttcacctcccaggttcaagcgattctcctgcctcagcctcctgagtagctgggactacaggtgcatgctaccacgcccagctaatttttgtgcttttagtggagacacggtttcaccatgttggccaggctggtctccaactcctgggctcgag

SEQ ID NO: 2129 - DNA, 1223 bp, Homo sapiens
  misc_feature (243)..(243): n equals a,t,g, or c
  misc_feature (1218)..(1218): n equals a,t,g, or c
ggcagaggccagactttggacctcccactcagaggtttctgtctccatcattctgacctgctgcttgtccacatgtgggccccaactccacttatccacctaggacttggtaaaatgcaaatctgagtatgctgcttctttactgaacacccttcaatggtttgccaagtctttagcatgtggcacatgatgtccttcacaccctgctccctgccttgttctttggccttgtgcctccctatnggccccgcctgcctgcccccggtccccctccccctcacctccaacatccaactgaaagccaaggctggtttgctcctgagacaaaggctctgctccattgcgtcagttcacctccctgccctgctggtgtcagcaaggtaacaatcaagctggtgaccccaccagcctcatctcccagccggtcctgccaaaccttcttgacattgccagtttgtgaccgtgaaggccacatggtcctccaaatcstttctccccaagaaaaggtgcaaaattgaagcacacatgtagggggaccctgggagttcaaggagcccaggttagaaatccttaaacccagcctgcttcacacaggggctggcttgatgaccgtgagtgctgccttcaccttttccccactgagctaactcctaactcctcacccgtgacacggctcaagatcgcttctcttagaaggaagtcccgatccgctgctaccccacatggcccccaagctggattggtgcctgcgttcgttcccagcgctgccgtgaaaagtgactacaaagggagcagctggatacaacagggatttactccttcccagttctggaggccagaaatccaggtgtcaggaccgtgctccctctgaaggccctaggggaggacccttccttgcccttctcagtgtcccgtggtgtctggcatcctctgtgtccctcggcttgggacagcccctctctaatctctgcctccacctgcacatggccatcttccctgaatgtgcctccaaaactctctcctttataaagacaccagtcattggacataagccccaccttactccagtgtgacctcatcttaaatccatgacatctgcaaaggtccttatccaaatggcccttatcccaataaggtcacattcacagggatcaggggttaggcctggaacgtatctttttcagaacactattcagccagcccacaccagcgcccccnacagg

SEQ ID NO: 2130 - DNA, 1626 bp, Homo sapiens
aattcggcacgagacaacaccaacatatctgcagcccatagtgcaaatgtccatgtatgtcagattaaatgttacttattatttaggtctgttttttaaattaaagtttgcacttgctttgcagccagccaggcagggagtcattacctagctctttcacttactcatgtgccaatgtgaatgtgttacttcacttctcctgcctcttgtctacagtgggcaggaggtaagcctcacggtgtgactgtgaagccaagtgaaatctcacacctacctcagaggcctttttcccactctccttttctgactcttttaatattttctcaattatttatagtaataataataatacaatgccaattgttcattcattcatccatttaaatcccaaaggaatttaaaagaagagtaacatttaacctgacaaagacaaaaggaggaagctttttaggtaatattaattatcataaagcaacaataataacaacaataataatagcaagctcatataagcaagaagcaatagtcagtgtgtcatgttttgggggaattaagaatttcaaatagttcattttaacaccacctttctcattccttattctcctaccccactggcctgatcacttctagaaacttccagattctttacctcttcatgacatttataattgctgttctttttttggaggtacaatatacatataaaatttaccatctttatcatttttaggtgtacagttcagtggtaatatatctaaatttatattctttatttttctgttctttatgtctaggacatttcaatcctcaacacttcacattgctaaatcctcatctctcaagcctcagcttaaatattaccttttcagagagaccttcacagatgatgtaatataaatcactctcccctaccattattctcaaagacagaaatctattttctttattttactaatcacaggctgaacttattttgctgactttattatctggctctcctacttgacagtaagttcaacgagggccaggacaaagtctgtaccccagcagttagttagcctgggttccatacatatcatttactcaatagctatttattaactggataaatggaaatgaatgcaagtgatagggatagatacaggaagagaattagataactaaaccaaggtcaggaaatggcatggctaaacgtttgcactaaatctttaaaactctggaaaaatcctggaaggatctcagtggacaaatgcctccaatacgtttctattaaggaaaatcactctcataagaatgtaggggaattgactggaatgagagaactgagggagggagatccattaagggtctgactgcagtaattcagatgagaaatactgcaaaagcttaggctaagttagtggctataaagatggaataaatagagtcaagggttattacaattgaacagaatgtggtgtctgactagaaataaaaagacaatctagagaagtccaaaatgacttatagatttctgacctgggcaagtgaatagattagaaaacaagatttgtagggaaagatgaaaaacagttattggatattttgaatttgatgcaattattggatatgtttcagtctggagct

SEQ ID NO: 2131 - DNA, 1347 bp, Homo sapiens
  misc_feature (830)..(830): n equals a,t,g, or c
tctcccctacactcctctccagccacaggagttcctttraattcttggaacatgccccattcccacttgcctttrggactcactcacgctgtccgtctgcctggaacacgcttcctccttctgcttgcttggctcagtcttacatatcctccagctctcagcttaaatatcagttcctgtagggaagccttttctgtcacccagtctaggattgcactcattatatgctcccaaatatagtgctcccttcatggtgcttggtatgcctagtgcaattctcgtttactttcctgagtccatctcattctccaagaattgtcaccactggtctttatactcctggaaggcatgaacccaatttattgtcttgctctctgctgcatctctgatagccagcccaatgccttgccataattgttgaaacaaaatgcatgttwatctattgaaaaaaaaatttttttttgagawggagtttcactcttgttgcccaggccagagtgcaakggtgccatctcggctcaccacaamctycgcttcccaggttcaagggattctcctgcctcagccccctgagtagctgggattacaggcatgtgccaccacacccagctaattttgtatttttagtagagacgggatttcaccatgttggtcaggctggtcttgaactcccaacctcaggtgatcctcctgcctcggsctcccaaagtgctgagattacaggcgtgagccacctcgcccagcctattgaaaatttgarttggagaataaaaggattttggaataaaaattaaaacaaagcttcccatcatwggayccsccttatgtancttgtacctgtggcaaaatacggarttgtcttctatcarttcttctgctgaagcccagggaaarartgtwtgtaaaaatgtctccctgtggctgagagccagctttatctttttatcctagtctgggctatcatttttatttttatttttatttttattatattagagatggagtttcactacgttaatgttgtccaggttggcctcgaacccctggctcaagtaatcctcctgcctcagcctcctgagtagctgggactacagggatgtgccaccacacccggcttatcatttctaacatgaaaatttaaaagttaactttaaatttaatgcgttaaagtaatctaacccagtaacataaaaatgtgaagttgggctgggcacagtggcttatgcctgcaatcccagcactttggaaggctgaggcgagcagatagcttgagcctggcagttcaagaccagcctgagcaacatggcaaaaccctgtctctaccaaaaaaaaaaaaaaaaaactcga

SEQ ID NO: 2132 - DNA, 741 bp, Homo sapiens
  misc_feature (86)..(86): n equals a,t,g, or c
  misc_feature (92)..(92): n equals a,t,g, or c
  misc_feature (640)..(640): n equals a,t,g, or c
  misc_feature (673)..(673): n equals a,t,g, or c
  misc_feature (696)..(696): n equals a,t,g, or c
  misc_feature (712)..(713): n equals a,t,g, or c
ggaaacagctatgaccatgattacgccaagctcgaaattaaccctcactaaagggaacaaaagctggagctccaccgcggtggcgnccgctntagaactagtggatcccccgggctgcaggaattcggcacgagtccatacggggagcacccagcaaagggccccgcctcccactctgctctgtggtggccatggggatgataatttgggtaaacccaactggcttctgggagagcaagaaaggatgtgaggggtaggggatagaacagcccggggcagacaaagaacctcagcccaggcaggtagggaacttgagacctccaaggtctgatttcccctcacccccaccggagggctccattttgtactctctaggctgttggcaagaatgcggaccagactctggtgataactgctctgagcaccaggcagctcttggttctccctgctgatggggggctcggtggcacacttaatcctggaaccatcactcatccacgagccacttgttgagcccctggcactctctcttgtcccagcatcactgctgaccctgtcagcctctgagcccttgctcgaaggggggcccggtaaccaattcgccctatagtgagtcgtattacaattcactggccgtcgnttttacaacgtcgtgactgggaaaacctggggntacccaatttaatgcttgcaganattccccttttgcaanntgggttataacgaaaaggccgcaccgat

SEQ ID NO: 2133 - DNA, 962 bp, Homo sapiens
  misc_feature (294)..(294): n equals a,t,g, or c
ggcacgagggcagactcagggcaaacaacgggaaaataaaaactcaactggtgaagtcagacaggctaagttgagctacataaaggggaactgagccagacaagggaggaaagagaggtggaggaacctcacaggttggttgtcgtggaaagtttttgttctggctgtgaaagtaagaaggaacataagatttcaggaagcacctgccatctggatgaaggagattgagaatggcagcmattgggartaatggattttaaagatatcttggtgtgcattaaatgcactcttcancccttgggctttttctttagagactgagtatagatttgaattgctttagattatatattttttgaatgacagctgtttctttgaatgtgactccacaccaagattkgaccacaaagctgcctggcatttacagaagaagccaaatataacatggatcaatggtaaaccactcttgataaatacagagcgggcatctcagaraccccgttagcttcacccttgtgtcctgagatgctggctctgaccctgggggctctgtgaagtccagtctgaaatcaccctctagatccacccacagtcccttccaactctaaaagtcattgtgcaatgccagccttgcctcacttttagtcacagacactgaccacagggaaatgtagactctttctgattacacatctgagttgccacattttggaaaagatgcccttggcatggagcctctaccggctctgggccatggggtgtggttttgtgaatgggacccactgtggtgccatggagtccaggtaacatgacccagttctctgccttgcctcagagcggacgtctagttaccaccgccagcctctgcaagacttctctgattacccaatattttcctcttgtctgcagacatgacttctcataaatccctttgctgtatcccctttggaacagggctcgag

SEQ ID NO: 2134 - DNA, 943 bp, Homo sapiens
gtgtattttgataactcagtttcccaccttttttctccaatcagagtcccgcaagagctttatttctatgctgcaatttcaaatgacctacaaattcttagaagtgtaaagaactaaaaatatgtaaccaactaaaattgggttgtgggaggctgcagaaagcagagagagactaattcaccattgctcaaaataaagtgtcaatactgtctaaagaatgtactctccaaacttcacatcaaacttttttgggatgcagtgcgatgtggtacagagagtaacaggttttggagtcagatggctctgaattggttgacactcttactaacttggacattcgaaagttatgtagtcacttattttcctcatctgtagagaaaggctacactggtgaaatgagatcatgaagctaaaatgcccaaaggtaggcctggggcacagttggttatcattaataatagttattatcagttgtagatacttaggaggactaaaataaatatggaacccaatatcctagtagatgagtaagagagggttcgcagacctcgtgggtgtgaacgtarggagtgttgtatggagtcagaccaaccaaacaaagggagttggcatttgcggtcactcagattttatgcagccaggttactgctggctctggatggttgacacacagtgtgatgtttcactgcatttgtatcaagataatggcgcaaccatccccccaaaatccagcattattcataatcgcatctttcatcatcaatttggggaaagtctttggtacacagtcaattcctggggatgcaaatgatgatttcttccttttttttttgagacggagttttgctcttgttgcccaggctggagtgcagtggcactatatcggctccccacaacctccgcctctggggttcaagcgattctcctgcctcagtctctcgag

SEQ ID NO: 2135 - DNA, 1120 bp, Homo sapiens
  misc_feature (68)..(68): n equals a,t,g, or c
  misc_feature (133)..(133): n equals a,t,g, or c
cttgctttggcctcccaggcatgagccaccatgccaagctgttttctctgttttatcctggaatctcnatgggcctcagcttagcaattgtgagggtgggtatgcaggaggtggggtgtgaggaggggctggnaagcaacctttagaagcaggtctgaagggacttgtcaggggttccccaggtaggaaataggggtcacctgtgcccccagcccacctgccattgaggtgctagcccccagaggctgttatctttgtatagatgctgggggcatcaggacagcctgaaacactgtttccaggagtacagcatagaaaataagtctttccatccaaattggaaatgaaaaggccctggtacttgacagatctactccagtgacttggaacactgtgtgggagacttgtccttggcagcagtagaaatggggcggctctgaactttctctctgtaaccccaggcacatgtgtgcagacttgccaggccctgtgggcmaagcggatgtaggacctggctcttatccgggcatttggtaactcgaggaaaatggacttttcctcttctgctgcttttgtttttacctttggggccttatcatttgtggcatctgccctctaggacctatagcttttgggactgctggtagacacctattctactagcagagttttttcccccaaggcaggtgttttgatgagggcttgggtcacagcctcgggactcatggctgctctgtatcttccatcctgctggcctggaccacacggttccatgactttgccagattccttggcaggtttcattaagagagatgcacaggccggacgtggttgctcacacctgtaatcccagcactttgggaggctgaagcaatcagatctcttgagctcaggagttcgagaccagcctgggcaacatggcaaaaccccatctctacaaaaaatacaaaaattagcccacgtggtggcacacacccgtggtcccagctacttgggaggctgaggtaggggttgagccctaggggttgaggctgcaggaagccatgatagttcccctgcacacttcagcctgggtgacagagcaagaccctgtctcaaaaaaaaaaaaaaaaaactcgag

SEQ ID NO: 2136 - DNA, 402 bp, Homo sapiens
ggcacgagcatttgcacacacagccacaaacttgcacaagcagcacttgtacactgacacatatccgtttgtgcctatacagtgcacacttacacatttgcacacagctgtgcttgctcacacatttgcacacacccacctacacacttgcacacatactacacacttgagcgtgcagcacacatacctatgtgcatacatgcacatttgcacatgcacacagcagtggcacacacttctctatcactctccctagtcactgttctcccctgtgattcccacccctctgaccgcccctgctcacttgctgccccctccactggaaggggcctggcctggtgccctgtctctgtctgtctccaccgtgcagggaggtttcacaaggactggctgatgtctcgc

SEQ ID NO: 2137 - DNA, 214 bp, Homo sapiens
ggcacgagcggcacgagtgtatgtgtccctccaaaattcatctgttgaaacctaagacccaatgtgacagttttaagatgtgggaccttttgggaagtgataagtcccgatggctctgcccacatgaatgtattagtgagtgcccttgtaacagggctggagagtactatctacgtaggccctctttgcctttttttttttttttttcctttct

SEQ ID NO: 2138 - DNA, 570 bp, Homo sapiens
ggcacgaggtcgcatgggcagccctggggctctgttagctctcctcccgtcccttctccctttttcctggggcctgggtccctggccactactgtcctcacccaagacgtaggcggccaccaacttttgtcccagggagacgtgcaggacttgaggcagctggctgcagagttcgtccgggagtgggagcagcaggaaggccacagacacaatccccgtcagcaagaagaggaggaaggagctggtggccagttgctggcgggggtctgagaaacaagactcatcagatgctgcagcccccactcctgcccagcccaggtcctccagggagaagcctgaacaaggaagatgtatctacttttttttttttaattatcttttattttttgtagagatggagtcatcactacgttgtccaggctggtctggaactcttggcctcaggtgatcctcctgccttagcttcctaagtagctgggactatgggttcatgctaccatgcctggctaatttttaagttgtttgtagatggtcttgctatgttgtccaagctgatcttgaactcctggc

SEQ ID NO: 2139 - DNA, 1811 bp, Homo sapiens
  misc_feature (5)..(5): n equals a,t,g, or c
  misc_feature (1024)..(1024): n equals a,t,g, or c
  misc_feature (1127)..(1127): n equals a,t,g, or c
  misc_feature (1160)..(1160): n equals a,t,g, or c
  misc_feature (1728)..(1728): n equals a,t,g, or c
ggcanagttttctgctaattctaaaatacatgtcatatctcagtctgattctaatgagtgctttgtctcttcaggctgtgttttttcttgccttttagtgtgccttgcaattttttgttgaaagttgggcatgttgtaattggttatagaaatttaagtaactaggcctctagtttaaggatttatgttcatctgggtaggagttagtctttgtttaatgtttactgtagctatagatgccagagacttccgcttcctctcatgtcctaatttttatctcccttttgacttctagcttctctaagtattcctcatcagaaagagtttatttcttgcatttcttttatcygtaatccattatcatgctcccggaaccctgtaggtctggaggtaaggcgtgagaacattctataatattccagttcaattgtaatcttttagtagtctgggtctttgsctggtgaccttcacaaacatttattctttttttttttttgagacaaagtctcaccatgttgcccagcctggagtgcaatggtgcgacctcagctcactgcaacctccgcctcctggttcaaatgattctcctgcctcagcctcatgagtagctgggatttcaggcgcacactatagtcacccacttaggtgagttaagaaggttaaagggggctgaagtgagaggaatctcctccctcacatccgttggacaaggtcctgataaagtatttcttcataagagtaggacttttattaatggagagggctctgggtatattgcttaaagattagtgtttctcttctgctgttagacccgccaaatatttggggattttccagttatctttcatcaattgatttctagttcatttccactgtggtctgagaacacactttgtataactcttattattttaagtttggttagatgtacattatggcccagaatgtggtttatcttcaccttgaggtaaagtccatggggcccaggccattctttcttccaagctagtacacactcagcctncagcaattcactgacattgccatttaagtattcctaccagtttatggcactagtggattttaccccaggtaggtagatcttggctgkgagtctctggatttgnctctctagattttcgaaaggcagtttgscttgnaaactcagktctttgatgagttcaagaaaagttattgattttctctttgcttggctttttcttgtggggatgggactgatgacatccaggctcttttaaagttggggctgaaacttaaggttcatctttcatcttacgtttttgrtacatattcctmwgttctactgkttttagcwttcctatatctgactgcccttagtgtaccttctatactcaatgtactgctaaatcttgtcctttttagtccaacctaaaagtctttctcttggcttgtacatttacatcatttacattgatcatagtttctgtgaaaatgttttagtttctttcacgttatcttgtatgctgtgtttgctttattgcttcttttcctgctttctactctattggttgcattttcttctgactttaaagttatactttcatttttttttcttctggaggttacaccaggccaattagggctcataactaaatttatttttctttattaatttttaagtttctatagcctatcttccttctgaattaaagaagtatttttgcacacctttaaccctcagccacntctggcttaccatgaccaccttctacccaccatcccctcggtattatgtgttggtattctccaggattaagttcagactcgag

SEQ ID NO: 2140 - DNA, 462 bp, Homo sapiens
ggcacgagcccagctttagttgctggtgcccagatcatatcgtggaattgtacaggtgtaagttaaaaataaacttagagcaaatgattctcttttgattccctacccaatccacactcttccctgtcccctctatgtcattcctggcaggtggacatgaagctccaggtaagaggcaagcatccgtgttcaaatgaccattcccagtttgaatgactttgtttgcaggatcttacttctgcttaactaaatttgtaccccaccctctatgcacttaaaatccctttaaaattcgttgatccttagttacctccctggagctccttctatttatacacaataactggtttccaaatattgaaaatcaactcttgtagcccctctagtttttgtttacttacttgcttcattccccacgggctgaacactccagttccctggacttttctcatatgatatgta

SEQ ID NO: 2141 - DNA, 534 bp, Homo sapiens
ggcacgagaaaattcatgaaaagtatctctttttttcaataattagcagtcttcataagtctgctagtggtgttgattacttatttaatatttggcttactggaaaagacgtccttaattttatctttcagtgtttcctgaatgactccattccccttactctagtaattagcaagcatttttcttgaacacagaatacacacattcacacacttcagtttttaaagcacagttaggcaatgctaatagaaaagtgccagaatcagaattttcttaattcctctgtgctcaacgtctcttcccatccccaagttcttgccattggggagaaaattcttacttttgctatttgatttaatctttaattctatctccatgattttctgttttgttttttttttccttaggatgactgtcttttgaaggtttggtataatgtagaaaactggcggacagctgttacttctccagatggaagttcagaaaaacaatcccaaggagaaattgacttttcttttgtgtatctggcccatc

SEQ ID NO: 2142 - DNA, 1011 bp, Homo sapiens
  misc_feature (383)..(383): n equals a,t,g, or c
  misc_feature (925)..(925): n equals a,t,g, or c
  misc_feature (948)..(948): n equals a,t,g, or c
  misc_feature (976)..(976): n equals a,t,g, or c
agcaaaaagatacacgggcctaagataaaagatcaactaaacgtctcgtaaagcctctaaacagggcaggaaagcctgggccaacgtggagatgttacatcaaaggcagcagcagctcagtgatcctcacacacagtgggctgaagttaaaaaaagcagagtcatcagtggttcacaatttacattataattgtaatttattatttgcatgtatagttatattagtttatgctttgtttgatatttcatgtttaccatatctttatttgaaatatagtaaatatttatttctatacatatttggaaaaaatatattctgaacaactttttcttaatgctagcatccctggtgttgtggcacttttcagaataaaccctagcanggtcaagatgattggcattagccttcttctttaatcatctcaaaccattgttccctttgcttactatagtctttctgtgtttgcctccttttcatttcttactctaaactctttcctgccatagcctttgcatttgctattccctttgtctggaatgttcttgccatgactctgcatagtggctttactgacacatatctacaacacataatttgtacagagatctaaatattttttccagatttacattcaatgacctttgtataacagatatttctattatatcaagtactgtgttatctacttggaaatattgtcctatcttaactttgccacttgtcaattaattaatatcattgccatttgaggagtggaggaatttcagagtggcttagtgawtgcacaaagtcatacagctaataaacaacaatgccagggtttgaacccagggtttctgartttggatctcttttgcattaatctctgacatcactcatgcttttgcctttctgtatccagcagtctctcctatctatttttantaataatcaatggtagtttttgnaaattgtactcctgtgtaactgaakgcntttaakgctttaatttgmacttgtaataatcattg

SEQ ID NO: 2143 - DNA, 1665 bp, Homo sapiens
  misc_feature (1004)..(1004): n equals a,t,g, or c
  misc_feature (1010)..(1010): n equals a,t,g, or c
  misc_feature (1122)..(1122): n equals a,t,g, or c
ggcacgagggaaaagttagaaatataataatgttagaccttaagagtaggacccacgaaagttgcaaacacttctagccttattattcacatacctctcatgaagtttcttggttcttgactctttctattgctaccggttacaacttatgaaaatattacatattgacatggcatgagtttttactatcgttaagcccaaaagctttctcccgctgcttcaactctaaagaatgatcaccggaaaattctgcattgacttcccaggtaatatcttacctcagagttctttatgcctctgcactggtggtggccattcacactttgggcaggttcagggtagctgcaaggtcaaagcacagtatctggaacgtaagtgattcagtatccgtctgttgaatgaaggacacttttaagaaaytttctytcttctagactaaakacagagagmgaggaagatgaaaagaaactacaggctctatctgggttatgctaacttcaaaaatagaagggaccagtgtaactgggtaacacagaaagggggaagatctgaagacttctttggaaattctagcaccagacagccacaggaaagaaaggacccaaggactccaaaaaatattacacaatagaaaagctgggatttggggatgaggcctaccaggaatccatcagcatgtacttcaaaacctctgttactaaaaagacaagggaagaagtttggcccaaagagccaagttggaattgctgatattatacagctgaccttgggtaagaaggaggagaaagtgtattaagcgtgtatcagttggctaacagccaggctgtgactgcttattcagagaactagcattcagggaggagggcttggaggctttccatgcaggagtgggaaaaatgcctcttatttcttttctgggatatgcacccaaggggagagacaaacttgaaaccgcatacaatatgggaaggttctgggcttggcatattatagcatctcttctncttttncacaccattttctycagaaacaactctgaatcacaagaagttaaggaaaatgcaatttcaaccctgtgtagaattgagagacacctcacaaatagatgtggttcccagatancaattttctagggaatcttctcaggtacttggtgtggaaaggactgacccatgtcaaaccttgtcacctctcttgtgtttgaatacaaaatgtggcaaaactaaatcttggcttttctggggacaaataaatatgacatgggtggattaatggaaagacatttaactttcagtttgcaagatgaaaatatatctgtaaaaaatcctaccacaacagtattcaaaccatatgttaatggctcaaaacatctgtagtactgtaacttgtcctgaaaaccctgctggttttaagcactgacgggaaacagtatgcaagctgaagagaaaaccgctttttgataaatatcacctcctcctttaaccagttcaccccctccccctctcaggatacccatatagttcgcaaagtgttgttacataggaaattctaactcttctcagagttttccaatctataaagcagctaatttgtacaggctacattctgaagctaagaaaacattttcacacaataaagaagagtaaagtctggaatgatctcgag

SEQ ID NO: 2144 - DNA, 963 bp, Homo sapiens
attgggtacgggccccccctcgagcattctgcagggactcatcctggggcaggtggggtcagagggcagatggccaggagcagagccagatggggagcaacagccttccctctgccaggacagggagagacctggctgcctcacagtgagaggtctggcagccagggagggcactggggacaagggcccagccgggcaccctacggagcacatgacccccacctgtccatggagcacacgacctccacctccagctgcccctgtgctgcagacaactcccagggtggcgagggtggcatcctgatcccagcagcgcctgcaggactgggaacctgctgcccacccaccccctgccacttgctctcccttccttgcccaaccccaggagctcaatgcctgctcagggcrggaataaraggcagaggaggggtgaggagagaaaggagtcattaggggccttgctgatccttcgtggcgcctccatgtccctatccctcatgcaaagcactaacctggaggcggagcatttcatcgaagcaaagcatctcctgccaccaagcacgtccacggtgttggggattgattgcttctatcctccagcccactctacggagcacccaccgtgtgacaggcgcggcgctgggcaacgaggataagaaaatgaataggccacgacatgtgcgcctgagaagtcacagactcagacgggagacaggctcgataccacacaccaaggtctggatgcacacaggacactgagtaactcctgcagggtgagcgggtttccagggcactcgacaaccggcagagtctggaagcagcctggaggggaaagggcattcctgacgggggcacagcagaagcaaaggcccagtggcatgaaagaccaaggagtgttgagggaacagagagcagcttggtgttggggcggcatcagcgggtggagctggagccgctcgtgcc

SEQ ID NO: 2145 - DNA, 1573 bp, Homo sapiens
ggcacgagtgataactgtccaaagaaatgatttttctttgctttcttggggcctttcccttttactttgataagtctttcaaggggtttgcagttcccccataatcgttttgataggagaaagattttaaattgggaagctcacagaggcaagaggacagcgtttctcagaattccagtttgaccctcccctacccttcttccttgccacaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagattttcttaacaagttagaaaattcagctccttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaacattgcctgccctgtccctggatttgtgtttaccttgtgtaaagcaccttccaaatgatcttgagctgcctgattgctttgctatttttcctctctatccaccatctagctgggtttgtggccattggaaaccctagaaatggtatgcacaactttatatgaggcaggatgattttcagagaggcctgtgatcccaaatatgtattgccaatctcaggtacctctggagactgggtgaagtcaggaggttttttctgtagtacaaaatagtgtcaggcataaaaatcctatccagcaggaggtaaagtggcaaaatccctgtccctgaagatgattcagattgacgctggtagtcactggtctggatcagtttggaagcttcacattgaacttgggtgctagagagatacccttggagacttccagagccctagccttcattgaagaaaggagtacagggtctgtagactccaattatctgtaaggcactgtgacgcccagaagtggcaagacggatgggatgattccaaaaacagtgtgcaaatcatactgcaaaccaccactgaaaaatatggctaagggtactaggatccagtagggcttagctgctgtggtttcctgcaggaaagtagcgttgaggaaactcctgcagagaaggcaggagtgtggtgtgggaaatgtgatgaataaaagcactggaaagactacagctggctaccatcaataatgaagagaacacagaagagttgcatgctcagaatctagggactccaggatttctgaggtgctgttgtgcccacacctcaaaaatgtgctgagccaggtcccagcttgaaacaatgaactaaccggggccgggtatagtggctcatgcctgtaatcccagcactttggcaggccaaggccagggtaggtggatca

SEQ ID NO: 2146 - DNA, 1361 bp, Homo sapiens
ggcacgagctcgtgccgctgacataggacaggaatgagccttagtatctttgccatgaccagttgttggtacgtggcctcaccacaaacacagtgatggatttcagagcccagcagctgaggccgatggtcagttatgctctcatggttaaaggtcttccaggcacattctcatgacagccacgatatatttttgtaagaaattctaccaaggcaaaatatgattaagataggtagccaaaacaaacaaaaaagaaagaaaagccgcaaattcctccctgcttgctctttatgcatgctcctttgcaatgtgattttgctattagctccatcaagagatgggtctcctgaatctgagcttgaccacgtgaattgctttgaccactggagcattcacaaacatggcacaacggaggcttgaaaaatgcatgtgccttgggacttgccctctcttgttacttttggaaccagagacctccatgcaatgagcctagactagcctcctagaagatgaggacaagaagaagcagaaatcaagcaccttcccaccaccaggcatgtgagtgaggccatcctagactgtccagccccagccaagctgtcagtgaccacagagaccagctaagccaaactaaaaccgaaaggactgtgggaaaacctatagtactgtgagaaaccataaatgcttgttgttttaattcactcagttttgggacagtgtgttatgtagtaaaaactaattgatatcatttatgtccattttatagatggaggaactgaaacctggagacatgagaaagcccctcaatgaatggaagtctcaaggtgttcattggtcttcctcagagcctcctacagcaagctgggcttgatcggaaggctctgagtttgggggtagctttactcatttgtgttatttgcctaaaccctggagtctactgagatcgagacccccgaatttgatcattaataaatctcttttggatgaataatataaaggtgttaggaggcccttctaggccattgaagccactagaacagaagtcaaggaattctcaatcttcaaagcatgggaaatgaggggtacagggattctccctagcccagttagaaactccttcaggcaggacgtaaaatttatatttctcttctattcttcttcactactgtgctagtcttataagtctattgttcattcattcaacaaatacttattgagtgtgccaagaaaaaagcaaagatctttgccctcatagagtttactttctaggagggaaatagaaaataagcagaataaataagagaaatatatggtgtaccagataatgatgtgtgctaggaattaaaaaaaaaaaaaaaaaa

SEQ ID NO: 2147 - DNA, 1043 bp, Homo sapiens
  misc_feature (927)..(927): n equals a,t,g, or c
gaattcggcacgagtttccatatgttccctagctatttgcactttatgttctgtggaacgtctcgtggctgccactgctgccctaagaaaggcctggctgcaaggctgggaactcggctgggaaacagttccctgactgatataaaccttccctaatgacgaaggtggtttgcggttcctaatctttacaaacaatgtggtgtatgctggacatcactttcctcctagggctctggaattttggtatatgccaggcagagggtatcaatgtgaccaccccccagtaaaaacctcaggcaatgagtccctaatgaacttctcagatagacaacacttcacaaatgtcattacaacttatgcagaagttaagcacatcctacaggactcccctgggagacggctcctggtgcctgagccctgtttcctctgactcctgggagacggctcctggtgcctgagccctgtttcctctgactcccctgggagacggctcctggtgcctgagcccygtttcctctgactcccctgggagacggctcctggtgcctgagccccgtttcctctgactcctgggagayggctcctggtgcctgagccccgtttcctctgactcctgggagacggctcctggtgcctgagccccgtttcctgggtgcctgaggccccatgtgccttttccctttgctgacattgctgtgkattattcactgtaatgagtcttagccagagtgtgactgtgtgctgagtcctgtaacactgaatcacctcaggatgatcttggggacccttaacacatgcctggtccagtcttttgctttctttttttgagacagggtctcattctgtctggctagagtgtagtggtgtgatcacagctgactgcagcctcaacatcctaggctcaagtgagcctcccaactcagcctncctgagtagccaggaacacaggcacaggccaccacaccccagctaatgtttaaaatgtttcatggagacaggatctcgctatgttgtccaggctggtcttgaactcctggcctcga

SEQ ID NO: 2148 - DNA, 1113 bp, Homo sapiens
ggcacgagctgctcttaacctaaaactaaatacacaaaatgtggcgtcaaaaaaccctttacttcactttcctattaaatgtctcgtttagcctgtacttttccttttcgctttggtacttttttacaccatgcccccacccccatccccccacccctactctcgcgcttcccaacgccaccaagattgtcttgataagaactccaggttctcccacgaaccgttctgatactattaattaaaagcagtggcctcaggcagagggctcaggaagtagggagggcgcgggcccgcgcgcacaacttcagggaaaaggtctttatgatttcagcatccagagaccctatttctgaggacaactccgcacccatgtcctggtacatgaaaccatcaccaaacgcgaacgggaagtgtcctcttcctgcctaggtgctgctggggcgctgccactcctgctgaccgggttcagaacccgatttttcgcaaccgcggtggcacccacgccggagtccttacctccccgcgcgggctcaatcagtggggattaccgcccacccttaccccagtttacacgcaggaaggggggaaaaagggaagaaaattaaaagctcatgcagttctcctcccattcttttctagatttgggcacagctcggtgacaccttcaaagccactcgtatagaaaggaccgcgggcgggacgcggccaccggggctcaggttaaatttaatctatagctgagctactcgctcctccaactcacccagtggaccagtgtttgacccagggggcgaaacaacggataaagcagcctccgccagaatttcaaaaactccctggaggccactgaatgttttatgcatcagaagggaagtctgggattccggtcactgtggctaggaggggggagggctcggccagcagggtgagggtgggggcggaggcggtttcagccttaagccatccaggcctcgggtttatggcccggggctgcttctggccgcggctctctaccttgttgccccggcctctttcaaaaaagcagaggttttttgctccctggcgcagcccaaagcgagggcacagattgtcggagctctaaagctgccgact

SEQ ID NO: 2149 - DNA, 495 bp, Homo sapiens
ggcacgagcttgccttgtggcactggcagcagcagccaaccacagtggcagatgcagatgagaaatgtcaatggggctacagggatgtggagatgcaggggctattgggcccctgggcagaatgcaatctggtggctggctctcaaaatggtactgtgctgtagctgcttagggctcggggagttcatgagacccagcatgagctccctgtctggagcagtgccattatgaggtctctaggaagctcctcatgttagtctcagggcctgtgagggttgaggagcattcccattgataggattgcaggagtcttcaatggaaatatggaccactgggggtctctcatctttctccacattgagaaacctctctgcgctcccagctaatcctggctgaccacgatgcctggcttcctgtccttccttggccttggatgtttcctgtcacttctctgtttaatgcaaaaaaaaaaaaaaaaaaaaaaaaaaaaaaaaa

SEQ ID NO: 2150 - DNA, 1099 bp, Homo sapiens
gtccaaagaatctctggcttggagtaggcaagtatgatacaaggcagaaatgagcagtgggtctgaaaactgaggtgatcacttgaattcctatatgtgaaatgctgtgctccctgtcactttctctattactgtttgccaacagctcaacgcttaaccccaagtcataaaatgagggctttttttcacaacataatttgaggaaattatctggggagtatggccccagagaaaagctgttttatggcaagaaagagggaaaatgccagaaacagaaagacataggataaataaaatggtgtgcctaatccagagatgtctcaaaacacacaattgaaaggacgacatacggtttcagaagaaatatctctatgggggaaaaaaaagaagaagacttcacaaaatagttattatgattgaaagagagaccaaatttaggctatgatcaagattcagaacctccagagaaaacaaaaaatatatataggaaacgcataacccaaacataaactagatcagtgtagcacaactttaagcaatagaaaagagaatctatttgaccttcatcataaatcattcccctctgagtggcccaggggttgtgacattgggtccttggagaagaagatatgatttcagtatcctacatcaccctgtactaaataaaatgtatagagtcacagtaacattaatggtgcactgtgattttcaacttttactattagctaacgaacaaatgcagatgacttcattatggttgcatatcagaaattaaaatgttaacaaccttggtcaggcttggtggctcatgcctgtaatcccaacactttgggagggccgaggcaggtggatcacctgaggtcaggagttcgagaccagcctggccaacatggtgaaaccccatctctactaaaaatacaaaaattggccgggcatggcggtgggtgcctgtagtcccatcttgtcagaaggctgaggcacgagaatagcttgaacccaggaggcagaggttgtggtgagcagagatcgcaccactgcactccagcctgggcgacagtgggagactccgtctcaaaaaaaaaaaaaaaaaaaaaaaaaa

SEQ ID NO: 2151 - DNA, 670 bp, Homo sapiens
ggcagagaaaaaatggcagaatcatgcctgtacacagccacacacctgtggagcgccttgtgtacttgactttgttcttttctctgctgaagaaatgccatttaacaaattcaattacttcataagatcaaacacagccattcatcctatcttccctcccccaccaaaggaatgcattctctttgaaagctccagtggaaccaaggaaaaagtttacacccttctaagactacccccggcctactcagcaaggtcaacacctgggcctggcatgcagaccattcttcaatgtgactcagcttccccttccagacctccttgcccaagaggtcaagccccaggccgacacctcttctaacacacactgcttttacatttccattcggaaaggatgggcctttacatgcccatcccctctgggagaaccatcccataacgtcatgcagtgtgaaatgccacatcatccttacgtcctgtctcagctaccacttccctcaatagggctctcctctctccccagctggacgtaagcattttcgccttttgaactacctcttccccttgtgcgtgtctcttctcgtattctgcctactgcatttcttacacagttatgtgtatactcgtcttatccttgatccttgtctcccaccctctatcagagtacaggctc

SEQ ID NO: 2152 - DNA, 1360 bp, Homo sapiens
gctcgtgccgccagtgcttacacatagacggtgcattctctggaattcaccctgggtcagagccttctcacctcccagcacaagccagtagttaagcctcagtgtcccagttcggtgcactgggcaggagatgggtctcccaagaccactcagccatgtggttccttcagctctcagcacagccgagtccaggctgcaggctctccmtcrcaagccaactacagagtgacacatgttctctacacatgccgtgactgawtatgttgtgttctgaaaatatttgggagttaatttgtgttttgtgcctagtgcttcmyggaccggtgctcattgcatccttacagccatctacaagggtgtcaccattatttgtattttattagacttagagaggtgaagtgacttgctcaaaataatacggttagcaaatgactgaaccccgacccaacagggagaatgtgggaagaaatcaacaaagcttatttaacaggtatctgccaagggttggaaaaaataagatttattgytgctccactgagcagaacacagcccatcagaggttactgcaccttcaacgacatgtgcttttgactgacccatcaaaacactggtggcaagagcactaaataagttgcctatcatacttaatctttccaggattcaaagaggagtgtagagtgaaatgacctataagactcctgagcctaaaatataatctaatggactcagctttaaagcgctcattgagaggatggccaaaaaccagccgccacagtgcgaagcacgattcctccaccatccgcagtccactcgcacaaataccctcagtgaaacacttctttctctccacccacttttgagtaggatgaaatggcacattccattttcaaagtgggcagcttgcacgtatcagcagtgccaggaatttggaaaacgataacgtggaacccacagtaacttgctggctgaatttactcacccaggtgacccaggtcgatgagggcttcagagccacggggattttaaatgccgcttcaaagccaacaaggagcagaaccagtgctgattcgtgtttatgataatgacatttgaaaggctaaaaattacaaagttgtttacagagatggacttagaaaataattgtatctaatgtctcataaacataaaagaaagttattttgtggtagatgattgaaaagaaaaaatctcctttaaaaaggaaataaatatactagtttyagacagaaacaacttcaaaggcaatcagaaaattcagtggaattttaaagagggartctcactcaaagaattctctaaaattgcctaaacttaaaagcattatttttctcgagggggccgg

SEQ ID NO: 2153 - DNA, 840 bp, Homo sapiens
ggcacgaggcacgtgtttgcctgtgttcatgtttgcctgagtgcatgtgtgtttgcctgtgtgcctgtttgcctgcgtgcgtatgtacacgtttgcctgtgtgcacgtctgcacgtgtgtttgcctgtgtgcatatttgtctgtgtgtgtgcacatctgcatgtacatgggtcctgtcattgctgcccgtctcctcccgagagctttctctgcacgttggccctgcctttgcagcttctgccagccccgtggcgccgagtggccttcttcccagccccagtgggcgcagtggggtgggccgtcctctgagggcacccgagctgctgcatctcccgtcttcccgcatgcagtcctcagggcacctgtccatgagccccattcacaggagcagtccccaaggcacctgtcccacctgggccacccttggccctgcgtccgtagccagagcttggagggctttgtccaccaggcctgggaccctgggatccttcctcagagtcccccggcgtgggggcagtgtggagggtggcgcgggtggagggtggcccgggtggcggggtgaattcctggggagagcctgccccctggcggccacctgggagaatgcagggaacatggctgagcagcgtcggctgtggagggagggcaggggcaggggtcagggctgcaggcgtgtccctggggctgatagcggtgggatggggtctggccagtggagggtccatggggtctcctagcaaacgcagtggcgctccttaaatgacggtgccaggcggggctgttctccttggttggcctctgtgtcccttcaggctcccaaggcccctcctcacatcctcc

SEQ ID NO: 2154 - DNA, 1590 bp, Homo sapiens
gatttttgtttgtttgtctcttttgaccacctctataactcttatggatattcatcaaattctgtatcaaagaatttaagatttagtcagtaaaatatagctatgatatgacacagcacgattctgtgtaaagccagcaaactaaccagcagcctcagaaattttatggttctttctattgacagtctaaggtcctccctggttaccatttccccaaaagaacaatgaggaatttggaggttatgcattctcgcagtctggggatctgtgatagtcactctgttaggtgtttttgagccaccaggttcctcatagcagctttcaaatctttgttcctcgggctgtagatgatggggttgagaatgggggtcaccactccatagaaaatggagatgagtttgtctgcaaggtcctgtttgtctgctcccattgggtccttagacttgggcttcccatacatgaagaggatcatcccatagaagacgatcacgacagtgaggtgggcagagcaggtggagaaggcctttttcctcccctcagctgaggggattctcaggatggtggcaatgatgaagacatatgagacaaaaataaacaggactgggagtgcaaggaagatcatgttggtcacaaccatgctgatcacgttgatgcagatgtcagcacaggccaactttagaactgccaggatctcacaggtgaagtgattgatgacattgtccccacagaagggcagtcacattgctagggatatctgtactacagagttggtgataccagctgcccaggagccaacagccatgggcatgtaggcagccttgctcatgaccacagggtacctaagggggttgcacatgtccaggtagtgatcaaaagccatcatgctcaggagaacacactctgtggctcccatggcaaaggagaggaacatctgtactgcacaggctgagaaggagatggttttcctgggggtcaggaagctgtcaaggatgaggaggttgtatagcagatgtccaggaaggagaggttccccaggaagaagtacatgggtgtgtgcaggcgggagtcaaggatggtcaccaggatgaggaccccgttgcccagcaggatcaccaggtacaccagcaggatgaacacaaagaatgtcttctccagctatgggtgggcagagaggcccaggagaacgaaccccaacacaggggaggcctcattggacctgttcatggtgcatctgctctgtcacctggaggaactcagaggtcaacctcagcatcctcttactccaaaagtacctggaaggccaggcacaaatccttgccctgctgagcaactggagaatagcgctgatgatttgttcatctctatggggttctaggaacaatgtagtacaggtcaatatttaacttctgcttctggtaagaacaaacaggctaatttggactaactgtcttgcagatgaccattagacaaactggaaaaaatacataaaacattggagaagtaataagacaatgaggaacatagggttatgactctggggaaaaacaaggacctagagatgtaagtctagcacttgtggctgtgattcaa

SEQ ID NO: 2155 - DNA, 177 bp, Homo sapiens
ggcacgagtgggctgtgtacgtgtttgtgccatttttatgactgggaaaatgacagtgatgatgaggattcctagttctattgttactaataccgctatggagtctgaagtgccaggttttaaaacccaggtgtatcgctcattagctgtgtgaccttgagcaagatcttcaacctc

SEQ ID NO: 2156 - DNA, 1014 bp, Homo sapiens
  misc_feature (930)..(930): n equals a,t,g, or c
  misc_feature (949)..(949): n equals a,t,g, or c
agggataacctgtcatctacatttgaaaattaatgaacaattctcgttacatagataatatttttcagtgacagtcgtatttttttctgtgggagggtgcacatttatattcatgaaattttagtttccagctttgaactggcacccttgttaaaaattctgatttttttttttttttaaactctggggattttacttaacaggttctgaaaggcttggaggctataacattctcacattggaaattccttactaggaattacttagtttgaacttagaatgatgatgaacttttgggacttaaatatactataacttttgtcactaggatcaggaatattcagagtgtgaagtcaagtgagtggtgtaatcaaagagtctgaaaagaaccatgagacatcatgtagcagtcttgcctttaggcagtaatgtattaaagctactttgcttattctttgaaaggaacatctctagagaagttccaaagtcatccttggtgatatctttcaatgatgcagaaatcttagtcaagaaattaggaagtcttccctaaatatacattctgaatccttcctgatgtgatagtttatttgccccttttcatgctcttactagcaataagagtaagccgctcaaatgtcactcatcttttcatatctctgaataatgtgtttcctttcttttttaatttaaaggatgttcactaaacaaagttttggggaacaccagaaaagtagaaagaacaaaaaagataatacccactggtattgcactatccaaatatgtaatcactgctaacaattcctgtgcatttttaaaacttacaggcgcgagcactgcgcctggccacattttcatattactatggtatcctttctcaaggactcatggtaccctgtccacttttatcttattaaagggaaattgtgntaatataatggacgtctgnttttgcatgttgaagtggtcacatatgcctgtaatgtggtgctagtgtttctgtcccaaacagtg

SEQ ID NO: 2157 - DNA, 1270 bp, Homo sapiens
  misc_feature (155)..(155): n equals a,t,g, or c
  misc_feature (752)..(752): n equals a,t,g, or c
  misc_feature (767)..(767): n equals a,t,g, or c
  misc_feature (835)..(835): n equals a,t,g, or c
ggcacgagaaaaatcagaaaagaaaattaaaattccccaccaatgataacagccattggtatttttacatgcatccttctgagttttattagtcccatgtatatataaagaaaagttggaatgtactttacagccagctttatatgctgcttttntctctagctcttataaatgcttatttataagcattttctcaacataaattacttttgaaggtttcatttgatggccacgatatgccatcacaattatttttcagtcataatttatgtagctgatcttcattgttacacacatggatgttccccaccatgtggctgccataaatgattctccgatgaccaactctacacatagatccttgtcttcatctctgattatttccttatgatagatttctggtctcatcaggtcaaaggatatgggcatttttaaggctttgatatgtgttatgaaattgccctcctgcaaaggtggcctgggttccactccccatgaaggctcaacaggtttctgaggcctccctcacacctccttcagcatcttctctctcactttcctgcctcagcctcttctccctgggttcccttgtgaaacacaatagtaaaggattatattatcaaatatttaattatgtatgtatctgaaaatattttaaaagtcaacataattactctatttccattagtttgatttgcagcaaattatgcatttagtgtgaagttggaggtgcyttgctggttggagygcanatagcgkttggctgnctacaatggggcgggcgctggtgacaacagctcaggctggtaaagccgtatcaggtccttgcagaggnagggcttcctcccagctggggagcctcagtaccttggagctctgaaatcacaccaacaccacaaatgaccctggggactgggtgtcttagttatctattcttgcataacaaacaaccccaaaacttgtggttgctgaaaacaataaatatttactgtctcacagcttctgtgggagctctccatccgtggccagcagctcaggctcaggatctcccaagaagctgcaatcaaggtggccccatggccgcagtcaactcaggcttgactcagggagaaagtatctgcctccaaccttactcacacgatctctccaaagggctgcttcaggacgtgacagctggcttctccctgagcagacaattccagagaagcactcaggtcggcacgcaaggttttcccatccttttggcatagaagttagagcccagctcgag

SEQ ID NO: 2158 - DNA, 1100 bp, Homo sapiens
ggcacgagattacataaaaacaaacaattctcccaccatattttcagtacagctccgctaatgaacatcctcaaatcataccagacactctgtatttatttttctgatgtacttccctataatctgtttcagattatttttatttacagaaatgattttttccaagattgggaccaccaagaaactacagatgcagacatacgtcatatcactcctctagtcctgaatttataatattatttaactcagtttttctttttacctgagaacaaataaacaaaaataacaaacaccatctcccaccaaaataatacaaacagcaatgaaaaacttttctaagtagctgtgagtcaaaaaggtgaaatttcattgagctgcaaaactaatccagcagttttaggatatgttcacgttttggtaatttagatgactatttctacatttccctatgatccaggataccaagggacctgctgcctgagacgttgagatttagagggctttttctctgttacaatgactcagagcaaatggagagagtgtccatttttcatggatgatgatgcttgtaaattttcattcatatctttgataactgatgtacttagcaacttccagataacattggttagagttagctctgcttattttggttctaatttagaaggaagacagagaaaatactcattctaagtacctactttttgtcagtaactatggtagctactttatgcactttgtgtccatcagggttttccagagaaacagaaataataggatacacacacaaacacacacacacacacacacacacaggtttcacatccatagattcaactaacaggctctaaaaaaattcaaaaaaaaaaattctacaaatttccaaaaggcaaaacttgaatttgtcatgtgctaaatatcacacaaaagaaataacatgtaggcatggtattcaattgaataattaatctggatgggtgtggtacttcacgcttataatcccagtacttatggagtccaggcagaaggtctgcctgagcccaggagtttgagagcagcctgggcaacagggagagactgggtctctgaaaaaaaaaaaa

SEQ ID NO: 2159 - DNA, 1473 bp, Homo sapiens
gccacgaggggaggttggctcttccgggccatcccggcctctgtggagcatggccgggtctatgtgggcaatgttgcctggatgcacgtgctggcagcccgggagctggagcagcgggcagccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgcaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggctttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtgaaaaaaaaaaaaaaaaaaaa

SEQ ID NO: 2160 - DNA, 1291 bp, Homo sapiens
ttcggcacgagctcaaacacattacgtggaatgaggggggagtgtatgaaggaatcattagcaacagattagagtccccaccaaagaaaaagaaacaagactcaagggctttttgagctgccacctctccccagagagggctcagaaaaaagatggcctggactctgctgggcagggtggtgggtcatcacccatgaatcaaggacatgaactaacctatatacacctatgccagcattgcagctttggcatttctgggtatgagggatgcaggagcagcaagcttgatgcaaggggacttaggaacgggcctctaaacaaagcttctctggtaagcacaggatcttcccttaaattacgtgcctattaaggggtttaggatgccccgcccaagctgtggcttggttcttcttctatacacacacatacattcttaaattctcacatatttatagccctcacatataaacacagtgtctgaaacacaacataagcctttgcaaaaatatgcactagatagggaaggcctggaggatgcccaggcatgaaagtgtccacttctcagaggaacatggctttgggtcactgtcatttgcacctgcactgcattttcctttctctcatctacatgcagaatgcttcatattcaagggaggtgccacacccagtcagctgagctgtttacacgtagtgggctagcttgctcatgcttacctgctgtgtcttctgttcatcagttctttctactttgttttacagtccattcgtggaactctagctttcaattattgtttcataaatacaggcaggtaggacaaaaatgtggctgaatcattgcaaaatcaaaatattttctgggagaaaaaaatcatagcacttcttctactgacaagtcagaaacttcatgctctcatctatgtgcccatctgtgcatattcctccattttgtacctgtccatgcattcttcttacctctgacaggaaatttccacattctactcttgaatcctccttaatttagtacctgcagaatgtgcctaacagatgcttgataccctaaattacagtcagataaggcaggatgttaggggtccatgattctttggggagattttttgcaagtacatcttccttcctacaaaaggtaaaaaaaaaaaaaagcacccacagcgttcaagttgaaataactccagcccaatttttatgactccttctctgtacttccaatactcccttcctacaaaaaaaaaaaaaaaaaaaaaaaaaactcgagggggggcccggtacccaa

SEQ ID NO: 2161 - DNA, 582 bp, Homo sapiens
  misc_feature (297)..(297): n equals a,t,g, or c
  misc_feature (335)..(335): n equals a,t,g, or c
ggcacgaggcggcggtggctgcggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgacggccaatgtggttcccaccgttttctacccccgatcagccggagctagttcgccctcntccctcagcgagcacccggggagactgtcctaggagantctgtagagtccctcgattaccggtcgcaaacgcctttgggagcgcagtgtgmtgcgagcgccgaagggtgagacgcacggcgttcccgagtccccggcgagggtgtctgggacgcgcccctccctacggctgcggcggcgcacagacctcggtcgagcgaggcgacgtgaggagaggtggctacaggcttaagccatggcgcagaggaggggccgggcggtgtggccgcagggtccgcggaccggg

SEQ ID NO: 2162 - DNA, 1219 bp, Homo sapiens
  misc_feature (888)..(889): n equals a,t,g, or c
ggcacgagcatgaagatgcaaaactatgagctgatttcatattttaaatgcaagttagcaaaatttaccttctacaattatttgacaagaatttaaagtgcaattgacaaacctttcagaaaaaagctgggaattgggcctttggggtaaggttgccatatttagctaattaaacatacaagtttcccagttaaatttgaatttcagataaatgatgtacaatatttgggacacacttatacaaaaaatgctcattgtttatctgaaattccaatttaactgtgcatctgtattttgcctgggcatcctactttggggtacttcgaggtccctggctagctcctggtctatgtcttagtccatgctcagaagtcccatgtattcaaccagctgcttcttcctccattccagtggttcttttacaggtaggtgaggtcttaaagaatcttttgaaacttttgagccattccccaggagaatatctacatacaaaatttggcatctccagggtatgtgggtcccacgtgagccccaccccacaatggtcggacccaaggactcctcccacagtccatggcactgtgcagatggccagctacgaggaagtgagcatgttggactttgaggagttcaaccagactatgaaacagcaaaatcacaagaccttttttgccttctttgccagttccaaggacattggaggtaacagatatagccccaatggcatgcgggccaaaccagttgtagagacgggctgaagcatgttcgggaagaatgtgcattcatctactgccaagtaggagaaaagccttattggaaagatccaaataatgtcttcaggaaaaatttgaaaggagctgcagtgcttaaccatggaacccaggaaannctgatagaatctgagtgtcttcaggccagcataatggaaatgttctctgaagattaagatttgatgatggcagtcatgccttgatttcctgctctgttctggtaaactgcatacttggtttgaattcttgttagcaataaataaataaatgatgatgggctgggcacagtggctcccgcctgtaatcccagcactttgggaggtcaaggcgggaggatcacttgagcccaggaggtcgagaacagcctgggcaatgtggtgaaaccttgcctctacaaaaatatttaaaaattagccaagcgtggtggtgcatgcctatagtcccagcta

SEQ ID NO: 2163 - DNA, 1543 bp, Homo sapiens
ggcacgagtgtaactgtataatattgacaatcgaacaaacagcttcaatcatgtctattcatatctccaggcaaagttttgttcttcttcctttattttacaaatgtattgcttcaaaggacacatacttttgtggataaacaatttccactagaagaagaacaggaaaggtagctatttaatatatgcagttagagccatgaggtatggatcatagtaaataatattttgcaatgatactagcactaataaagatgatgacatttgcatgattagctatgtttttagtaaaggaaaattaatggataggaatatttagcttgaaggatacatacaacatgctgacaaacaaaactgagtttcagcataaaaatggatatattacacagagagtatacataggctcctaatgtctctgtgtgcatttgtatgcatattattcatctagtattttctttttacttccaagttggaatgcatttacttcatatcttattataagcccatttggtaacacttctgtcagatttcagttgcatattcactgttgaataaatcagtggttaataaatgtccttggaaatgtgtttagagataaataatgaactgctgtatctgatcattaagtgtacatcaagctcacatttttactctcagaatcctaaaaggaagatagcatgacctactatatatgtacatggaaaaaagggaaataattatagagaaaacatgtaaaaggagcctggtttattactcttaaatgggtacatgatagatcaaaataaatgttattacaactgatcaaaaaatcctactgcaaaggaaataataaataaagatggagagtcaacctgtccatcataagtgctttttgttacaaagccaaggacttggagtgtggacccaaccccacagcatgcaaaaccgtggggctctcaggattccaagcctagcatccccaccctctcataggcgcttcggagctgaccgcaggcacacttttaatttgtggcaagatggtctgacaaacagcttgggaggacagcacaggtgaaaatacagatcaagtgcagataaaaatatgttcaccttgaaaaatacaaacaagacttttaggtaataatgcacagggaaatcctatcaaaaaatgagaagaatagaaccactgctttctcattaacaattttcacaatcccttttagcttgtattccaacttctgtccataatccaatatctgcatactccttacatctatacttaaataatatagatttttgtcccctgtacatatcttataaatgtcaatccatcccacctcaaagtttcttggtattcagcaagttttttaaaaagtcaatcatgtaggagatcctttagcaatacttcaaggtatcatccctataaaaagtgaagagggatctgaggtcctaaaaagaaaaataatgacagagaatggctgtaatttcatatgttcctgatggaaatctcactgctcagaaaaaaaaaagaacacatatgccaaaataaaaaaaaaaaaaaaga

SEQ ID NO: 2164 - DNA, 817 bp, Homo sapiens
gcttctaggcctgcggaatgcacctctgctgggctggggctctgagttttgtgttttgggccaacctgatcctcatatatctatttggaaccagcgagtctccccagaatattttatcaagttattttgagttaggagtttaatagacatagaagcctttaaggagagtgagtaaatgaagttggcaaggggagtaggcaggggagagaggaggaaatcccaggctaagttttggaagagggcttgattatgttggtgacagcaggctgcatcttccaggacaggaatccccccgtggtttacaaaacacttccccttacataatcctatttaattcacacgacaagcccaagagttagggarggttcattgccttattagcctgtgtttacagatggtgaaactgaggctcagagaggtgctgagatcacacagcaggatcatgcagcagaccacgggcagggctgggattccggaccaagcttggcattcttttcctggcaccacagtattccctgcaagccctctgtgttttccactcctgagttagatgtcactggtggtgctgtagagggggctgctggagcactgtccttcatgtgaaagggggttccctttgccctttttgggtgcccacccacaagcttctctgtgctctgcttcccttcgctctccaagatgctaccttagagctactggagccactttgttcaggcagagggctgtacgtgccctagggctgatgtgcccctggaaaggtttgcagctaaggactgcctggagcagggatatgaaagcccagctttcttggctcgag

SEQ ID NO: 2165 - DNA, 829 bp, Homo sapiens
ggcacgagaaggcaggggccttgaatgaacaaacgaacctgactaggggctacatgaaagccatactgtgcttcctcctccttctcatgaatccctttcctcccttctcttttccatcccccatagatcagaaatgtgaaggcggttaggaaatgtccagactccaaacagaaaaaactgtgatcctcagcagacacaagacataatattggattatttccagcttcatcctgggaaaaatataggagactgaagggaaacaggaaaataagtaaacacccatagaaaaataaaatgtaagataaaaactgaaatgtaagaactatcacatggtgagtgtctatattcactcataatagagtaactacaaaatcataagtttgatatttaatcctaatgggggtgaataatttttttaaatgttgctactgtcgtgataaaacaaattagctacatactgacaaagtaaaagcgtgttttctaaaattgaaataattctcaaaataacagtttagaaaggctgcacattttacaggaaatgggttgaacatcacatgatttactcattaaggagataattattgagcgcctaaatgaggaaaaaagatttatagattttaaacaagcatccaattaactaaatattactgagtaaaagaaaaacaagttaatgatacttttgtaccaattttattataaaatgtacgtgaagaaaggctattttgtcaaactgtttttccgtatcatgtcatattttatatttacagcaacatcctgaaataggaatttctgaggatatgcttcccatttgagagatgaaaacctcgag

SEQ ID NO: 2166 - DNA, 783 bp, Homo sapiens
  misc_feature (743)..(743): n equals a,t,g, or c
  misc_feature (752)..(752): n equals a,t,g, or c
aaaacttggagctccaccgcggtggccggctgctctagaactagtggatcccccgggctgcaggaattcggcacgaggaggcaccgcaaagatgcaagaagtcacccggagtacaaggacaggacgccaggctttcagggggacgttgaggcagtcaaaggaaaaaaatggcaaggcagaagaggaggctgtggtactccaccggaggccagtgccttccatgcatcccctgccccgggcctgggggttggtcgttgggtccctggctttcacccagggtgcgtgtctctctcatggggggcagcccaaagtgggaagaagtcccctgggggattgggataagatgccaagctttcagagaaacgttgaggcatctcggaaaaaaaaagcagtgaggccagaggagtctggggtcctccaccagaggccagtgccttctgggcagcccctgcgttgggccttgggtggttgtggagtccctggctttcaccaagggtgcgtgtgtctcccacggggggcatccaaaaggggcaagaagtccactgggggatggggacaagatgtcaggctttcagggggacattgtggcagcccaaggaaaaaagtgacgaggctgaaraggaarctcggatcttccgytgraggccagtgccttccgggcagcctttgcgccaaktcraggggggcccgyacccaattcgccctaaagggagcggattacaatttaattggccgccgttttnaaaacgtcnggacttggaaaaacccctggggttacccaaa

SEQ ID NO: 2167 - DNA, 578 bp, Homo sapiens
ggcacgagctcataacaaaggccagaactgttagaaacacacatacctccccacacacccaaaacctgaacatgtcatcttcctacttacaacccttccatggcttcctactgtggttggattaagaccaagacccttgcgtggcttataaggtctgcaggttttggctctgccaacctgtctagcctcctggccctctcaatcagcttgctgtttccctcatttgttacacaagtttcatttttaaaaatgcatcatgggctgtttcctcctcctggaacattcttccctccctttcccctgacctgtcaatttctattatccttcatttccctgcttaaatgtcactgtttttgaggaagccttcaaatccccagattaggtcagaatcccctaacacactcactcttttcgcaccccatacttaatttttgtattatttttctccaagtgaacttaaataaccatataactgattaaaattgttctcccctgccagaacaagacccatgaggacaggagacccttttgtcatggcttctgtagcacccggcatagtgcttggaatagaggagaca

SEQ ID NO: 2168 - DNA, 1142 bp, Homo sapiens
  misc_feature (954)..(954): n equals a,t,g, or c
ggcacgagcatagatatcattccaatttttcctgttgcaagtaacagaaaaccagaccccatctggctgaagccartaagagaaaagactaacaggagggccagcctcaggactcaaatacgtcaccaggacatgggttgcgtcccagtctcagctctgccagttcctgtagaaccctccttccaaggttcacagggtggctaccatagcttcaggccctcacctcatgataagacagcaatacaackgccatttcatgtctgttgctgtttctacattcagttagaattaaataaattttccagtagcacccacaaaaatactgagtccacctggttggcctacctagatatatcgccagccctgatcaagtcactggtcacgggcctggattttctggttcgcttaggctaatcatacgtcccatcccaggactgaagaagtaccagggctgttgctggagagtggctaatgtcccctttacaaataaggagctcattgtttaggaagatgagcttgccaaaaatcacacacttgtaaaataagtcaaaatttgaacttaagtctacttatctgagcccaaagtcttacaaccatttatggctgttatcctaacacctacgtcgcggaacggaagagtcctaagactgcaaagacccttccttttcttctagatccagtctaagttggttggtaatttctttagaccctgctttcagggaagtttaaaaaaaattacttgcatttgtatattttccttgtattttcggccaaatttcttctaattaaagtacaacataagttgaaccaacacaataattgtcatattaagaaaagataaaacaaactttactcatttctgcttctgggcatggagtgtgagggaccagacttaagttctcaaacaactacaaaatcagaccaaaaaatacaatggtttccaggcaccggacnacaggcagtgcagggctgtgatccttaagagaagggaagcagcgagccagagtatccaggccacaacccaaatggaggccaagagaggaacagcagaggatacagagggagggttccaggggccaagacgcaatccgaggggaagcccttccggggagagctggagtcctggggtggccttctcgagg

SEQ ID NO: 2169 - DNA, 2478 bp, Homo sapiens
  misc_feature (591)..(591): n equals a,t,g, or c
  misc_feature (599)..(599): n equals a,t,g, or c
  misc_feature (1252)..(1252): n equals a,t,g, or c
  misc_feature (1272)..(1272): n equals a,t,g, or c
  misc_feature (1275)..(1275): n equals a,t,g, or c
  misc_feature (1402)..(1402): n equals a,t,g, or c
  misc_feature (1480)..(1480): n equals a,t,g, or c
ggcacgagtgacctttcaaaagttgatgaataataaaaaacaattcatatgttctctctgtctcttatactgtactttgtttcacaaatatttccacagttttcctggctcaatcattttaattgcaaaggcaagatttatatatcataaattattacattaagcagtagaaatcagaaatactgaggtgggaaatatgaactatccttgcataggaacagctggaataacctggtccaaaaatgtaataataaaaacaacaaccaaacatactgctctactgataattcagatttttttaagaaatctaatttttaagaaaaatcttgttcaacttgccagaagacaaaaatgatttgaaggttttaaaaagtgttcggttcattactggatttgagctggactcaatgtatctctactattattgttaaagcagaattatgtttaccacaaaactaaacagtttgcatgaccaataatgatttttaaaaaatgtttagctatgaaactcttatgtggttgtctcttgatatctagagaaagagaagggaaaaaattatatttatcaatgttgagacattagtttcattntacctaanaaaaatttaaaagaaaaacagttacataggaattgttaaggagtttgtagaacactcactcccttcatatgcattgtagttgggtatcacttaaacatctcaactaagctggatttctactacagcggtctcctaagtcaatcaggaaaatgttagtttttttggttgctttaaatgaatgaatttctcctagcaaatagaagcaatatgattttaataaacagtgatgaagactctgggaaacccttacaatgtagggtaataacatctttctattaaaaacaataatgttataaacatttcaacatccaaatgatgggacatttcacatactcatgccttttgattattttcaaagatgcttcattacctaactcattcttgtcacagaattcttgtagctaaaagcaaaaatagactcaaattgaaagatttttaaaagataactacttggcagcaattataggtgtatatacccttgaagatacaaagacttaataataacacctgaagaatatttccctgccccctyccacacacacacacacacacacacacacacacacacacaaatactagggaagtgtgctcctcctcagatcctccagctgtgggcttcctaattaaaaggctgasctgtttcctgctcaaancmcttcaaaagcctttttgntgntctccacttgcatatagttcgcagcacttgtccttcttacctgtccattcttatttatagagagctttcttgaatcagaaacccaagaagtgatgcagagmccattttattttataaagttgaaggncaataatatttatgttaaaaaaaaatccaagtagctgaattagcaactcagtaattttgctagactggcaaaaaggancaatgcatgtggcatagtttttaaaacataaatttttatagcataatttaaaaacagtatttattactggctgatttttaaaataaatgggtattttcacttgctgtaaatgtgacatgttaaaatctatttttaaaaaaatactgagtttgatattcatgtttaaagttggagactgttgtaaaagtctgcctctgaatttgatatcttagacaaggaatatttaccttggtacaaatcaaatggatgagagatctaaacataaaatagtcaacagaatcgtcttttgtggattcaaaatagaaacggtwcaagtrgcaaacactgacaaatwgccctttttaaaagcccaatctwaaaatcgacgtccacaaaagctttcttttccaagtatttgcctataaagttatttcaacacggctctgacaaatgcctgtgtgtcctgtcccatagggaaaggtgtgaacgcataacgttttgctctttgcaaaaaagggtcgttaattgkccgagagcasccaccgtttagggatgaagggagattaagtgatttttggccaatgcatctgccaattcccttcagggtagtcaagaatgggggccggcagccmtgctgcagttggaaggtctgtccaaaaaaggccgttttggagaaagagggagagactgcgagtggccgactgcgcccccctcccagccctccggcccgggcgcctgagccgccgctcacctcggtgtcattgttraggttccagaggtccaagcgccccatcccgtccacgcaggcaaaaarcscargatgcacgggggaccacatgacatcgtacacatagtctgcattgtcttcaaaggagtagagcggcttgttgtgctgtaaagcagagagaccgtgaagactttgtggcgctgctgctgcctcgggctgtctagagagcctaattaaaaactttgcacattcacaaagtgtcataaaacttcccgagatgaaagtcctcgag

SEQ ID NO: 2170 - DNA, 1092 bp, Homo sapiens
ctgcaggaattcggcacgaggttcatttcacttttcagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaaggtaaaatttctttattgccgtgttttacaatcttattataacatttatacttagttatgtgaacatgaaacattaaaatatacttaaaatacctaaaattaggtttgttttccacagtttactttggaaataatttcattaggtttttagtatagcaagcatttcagtggtaagctgtatatatttttaaaataatgtataccaggtgtagtggcttacgccwgtaatcccagcamttcgggaggctgwkgcgggyagakcacttgcgsccataagttcgagaccaacctggctaacatagcgaaaccatcatctctaccaaaaacacaaaaattagctgggcatggtggcacgtgcctgtagtcccagctactcgggaggctgaggccaagaatcatttgaacccaggaggcagaggttgcagtgagccaagatcatgtcactgcactccagcctgggtgatggagtgagactctgtctcaaaagaaaaaagaaaaaaaaatgctaggaaaaagaaataagaatgggaaaagctcatgaaaattaaatctataaatatcaaaataactaaaattttgtagtaataattttcataagactgaagaccaatataatgatatgaaaaaaggagaaaattttctttaatagcaagggggaggagggataagaatattagaacaaatccaaaaggtctgagatctgtttagctggagttgaagaaatttgtaacagagacaacagacgaaaagggaagtaaacaggggaagaaaattctcacagcagaaggcacaggtttctcgag

SEQ ID NO: 2171 - DNA, 846 bp, Homo sapiens
  misc_feature (22)..(22): n equals a,t,g, or c
  misc_feature (823)..(823): n equals a,t,g, or c
gatcactataaaaaaagcaggnacgcctgcaggtaccggtccggaattcccgggtcgacccacgcgtccgacggctgcgagaagacgacagaagggtacggctgcgagaagacgacagaagggggagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacanaaaaaaaaaaaaaaaaaactcga

SEQ ID NO: 2172 - DNA, 630 bp, Homo sapiens
ggggctgcatttcatctggaggctctactggggaaaactccccttgcaaactcactcaggctgttggcagaattcatctctttgtggctgcatggctcagggccacagttttttttgctggctggtggctgaaagctacctgaatttcctgactctgtgggcttttttaatgtgcccagtagcttcttcagtgaggagaatttctctagttcatgccagcaagacagtgtcatgtatatacatgtatgtgtgtctgtacatgggtatgtgtgcctgtgtgtgtgtgtggtatcctagtcacctttgccatcttttcttggttagaagtcagaggtccttcacacactcaaaggcaagagttgatgcaggtgtgaatcccggtgccaccgttggtctgtctgcaacaccagcttccatgcttggatcacacctcggatgcacacgcttgaagatcatgtgccacagaagctcatttgccaaccctttcaccaactctggtccatgcactcggcagccttcaggccacccttgaaggttccacagagcctccacagacaggggagtccctgaaagtaaaaatacctcatggaccagacaccccccaaaacaaagcaaagccactgcctcgag

SEQ ID NO: 2173 - DNA, 2521 bp, Homo sapiens
cttgcccaaggttatgtgtctattaaatggctgcgtctgtaaaattaaaatgctaactgtggccaccctgcttctctcactccccctagggctgctgtgatgagagcaaacacacccacaatgctggccacacagtaggatgtaataaatcgtggctattattactactttttaatacacacaatagccacagccagtctggaaggctgtagtggcaatggcccgagggcaaaaatccttggggccccttcttgcttggtctctcacttcaaaggctatgcacagtcagtcacaggaaacagaatcagagaaggactcacaacatcctggaggacgtgatgcctccaggacacaacagaggaccgtgcaccccagaatcaactactttgcctcatctgaccttccaaatagtcccaaacagaagggagcaggagatgatggccattggagagaagcctccagggctgaatggccccatgaatgggatgttgattctggaccagaatcaggccttgtttctgtgctcccattgggccccagtggcacagaccagcccttgtatgctctccacggctgggctggaataggcttttgatttcttcccactcctggctggaggacttgccggttaagctctgtggagtgtttactttttcaacaatggcagcaggctgaagaataggaaaaaacctggcccctttttctaacttagcaggccagggtccccttagtaaccaaaatgccccgagcaccagtctccaggcaggagctgggacggcacagtttcctcttgaaggacaatgctgccctcctggtggcaaggcctcttccaaaagggctggcgtggactcaagggccttcctgaagctcactgttcccaaggaaagaattggagcccagctcgctggacagtgcccggtcccccaaaggatcaaggcaactaggggaatgaagaaaggcaagaaaaactcaaactgggggtggggacaggaagcgcggatgagaagaaagccagaccgtcgccaggtgccggtgcctctcatcttaaccatgccatcagtcagggacactagcatctctgcatgggaaccaagtgggggcgcagagaggtcaaacaagctgcccaaagtcagagctaggaagcagcagtcaacttttgaacacagtcttattgcgggatctggccagcagcccgcaatgcaacggggctctctctttgttcccaggtggatcggcaggttgagaaataatagacacacacgagatagtgaaagctgggtccaggggggtcaccagcttctggtcctgcggtgccaacaatgcactggatataccagcatttattattaagtttagtgaaggcgggggtaggttagtgagggatttagggtcatttgattatgcggtgagatggtcacatggggatgaagtaattctttaacatagcatttgtttgtagaagtacagagcataactgagtggctcagtatatagagtacacagagataagaatttacaatatagtgtgtgcgtcagtaatttctaacagagccttaaaacagaaacacaatctttccgtaacctatgattagcaagctattaatcagcagtaacaattgcaacaaaagctggttacaaacaatccatggaaacaggacgtgaagctagacaaccagttagaccagaaattctcagaagggagtatgccctaaccctaaagaggcctagaagagccgtggcaagatgagggcatttatagccctatcttatccatatggacaggcgtccccccatgcgtccgtttataggctctccacaagggtcgtattccattcccagagctatgaacatcttggtgatgtgaaacctccctgactgcacgtccattcataggttctctgcatggggaatcacatcacacactgttggctcattttggcagtccaacctggcattgtctttacacaaccctgcatgcaattttgtatttacaataatcaggagcatttcatcttttattctgtagcaatagtttcagggggtctccctaaacagtctgaccccaaagctgactttcttctgaagatacccctaatccgatcgctcagacatcagaatgagtacctaactgttcaggacacacagttatatcaacatgctcagagactgctttctcttacataaaatactactttcctttttatcataaaaaataggatgggcatggtggctcacacctgtaatcccagcactttgggaggccgaagtgagcagatcaccagaggtcaggagttcgagaccagcctgaccaatggagaaaccccatctctactaaaaatacaaaattagccaggcatggtggtacatgcctgtaatcccagctactcgggaggctgaggtaggagaattacttgaacctgggaggtggaggttgcagtgagccgagattcagccattgcactccagcactccagcttggacaataagagtgaaactctgtctcaaaaaaaaaaaaaaaaaa

SEQ ID NO: 2174 - DNA, 1475 bp, Homo sapiens
  misc_feature (40)..(40): n equals a,t,g, or c
gaattcggcacgagattgacttcaactctgctttgcaggnaatgccttgagaaataagagggtaaatccatttgctgaaggatatcaccatacgtgaaatttctatctctccaacacactcctagttaatccactggattcttaattgagaaaaatgaccattcccaaagatagcttgattttatttagactattggctttcatagtatatgttttatggttttctacgaatattcactaccctcaataatctccacctacaataagctgcattgccaaagggtcctgccactgccaagtcatttgtttgtcctaaacttctttgttatattatttktacaaattcttaaaagaaataattgtcaataatcagttcttgagcatttactatgtgktttacataatagagatgatattaaatcagcatattttccattcccctgcaaatctctttgccttgaaaatcacatactctaacagtctcctaccattcatgctaagtaagaaaaatcaacccaggaaagaaagcacaaactacaacaaatcaatcttttgtcaactcaaagctgactctcttgagtccttagcaaatctaagtaaatagttttaaaagccaggatttgtgaaaacaaaatagtttttctgaattgtaatagctccctttacacatgttaaaatacaggcttatctagatcatggaaaatattatttgttctttttttttttttttttgagacagagtctcactctgtcgcccagcctggagtgcagtggcacgatcttggctcactgcaagctctgcctcccaggttcacaccattctcctgcctcagcctcccgagtagctgggactacaggcacctgccaccaggcccggctaattttttgtatttttagttgagacgatgtttcaccgtgttagccaggatggtctcgatctcctgacctcgtgattcccccacctcggcctcccaaggtgctggaattacaggcgtgagccaccacgcccggscaatttgttcattttcaagataatacctccattgattgctctattatgacaagcmctgawtgatataagtgttttgcatgtwttcactcctttctaccttacaacaatctccatctcatttgttcactcgtgtgtcccaagctcctataacatggactgatagacagtggacaaaataaatatgtgctatgtgaataagcaactttatgaaatatatactggacagtatatatttctatgtacattttgcagataaataaacagaggcacagagcagttatgcttcatttccaagattttatactcagtagtaataactaagattcaggatagggaaagtgattctcctaaacttcaagtgaggtggtcaacgtcattagagccaaaacaactctagattctctaacttcaaacctatacataatttataggattttctgccaaaaaaaaaaaaaaaactcga

SEQ ID NO: 2175 - DNA, 1784 bp, Homo sapiens
  misc_feature (555)..(555): n equals a,t,g, or c
  misc_feature (559)..(559): n equals a,t,g, or c
ggcacgagctggtgtgttgataatgctctgtttcttgatctggagactagttatgtgggtgtgttccacttgcaaaaaaatgcatcgagctcaagataagtgtgcttttccgtaaggatatttcatctcaatagaaaatttggcttttgtgtcaactctgcctaaagtaagtgggaaactacaaaaactggggacttggacatcttttaatcaaactatgtatcaatgtcatgtcaaaggttttgttatgtgtcatcttccttgaatgagaatggcaacaagttttttttttatcacacagatttcctatgtgccttttttccccagtcctgatagtctatgaaccaaccaaacttagggaaaagtaaaacagttaagtcctgtatttccaccttatttacaatataatgccctctacagaaaataatcacagaaacacagaaaatgacttctccagagatgagaaatgtgcatgtgacgccactctgagttatctccttcaagaagtatgtattcyataatctgggagaagagtaaattaacactccaactccnaagntcaataattataatatgagagagacaacagtggaaagaatgaatgtcctcaggcttaatttactagcmggraagamcagtcagaggaaaaaaaaaaaaaaaaaagmccgagamcaytgagctctcttctggaatgscagaaggmccactttctcctgcataaatgaagscagggctaatmcaaaacgttttctgggtattatttaacctctcctacccaggctattttagctcagtaggaaattcacccactaggtggaccttggagttcatccaccaccccaataaagattgcctttcttatttgaagtgatgatcacttcttccaagcaaaccaacaaaccctaggtattcaacctctgataacctgcctactaaggaacttcagtggaatcaggggatcaacgatgctgtccccaaactggcctaaggtgaaccaaggggagaagttaacagcagcacttaaattgatctactcatactcaaggattactgagtcttctgggcaagaaaagaaagcaattacaaactaccaataaggaaaggtgttttgaaaatagcgaaaaaaaaatgtcccctacacttcctttcaaaggtagcctcagagctagtctggctgcgcagatgaccagtgaaaataaatgaaaactgcagtacggttatagatgatccttacacctcagcttgttctcaattgcaaaaaaaaaaaaaaaaaaatgcatataatctaacactctcctgtctaaattgcttcaaactttctcagaacgaccttcatcgtggcggattctttttctgcaaacctttacaggttgcacctgcttcacacagaaccagcggaaacaaactaggaggagataaaagagaagaagtaggaaggtttaaaccaacacaagtcgattttgtacccaaaaaaaaaaaaaagtttagtctaaaaagggaggtccagtgaggaacaagacagagggtgaaacagaagtctggcttactcccaaggcagaaatcatgactcatcaaagctttcagaggggacagaaccagactttgcatttgtcttgaggtcatcttcgagccaagaaatgctctcttaaccgggacctgagaactttaagggtctgcgacaactggctgtgaggccttgggcaaaacctctaacgtctctggggctcggtttcctcatcaggtgaagccagggtccactctagctttactagtctctcctcgag

SEQ ID NO: 2176 - DNA, 1743 bp, Homo sapiens
  misc_feature (1561)..(1561): n equals a,t,g, or c
ggcacgagtgcattggttgccatgtaaacagccagcttctggcaggaaagcagctggaccaggtgacctggctgtgacagagaacacagatattgaatccatgaaaccaagagtaatcagtacaacgattttttttcttttactttttaaaagtgtttgtcaatcctttaagttctttttgtctgactgctgtcattaagtaagaaaaatatgaaataaataagtctttgggtatgcaaaattgggaagatggacaggaattagtccctctatgcaatttcctctgaatctttcataatttctgtatcctcatcccttcaccctcaaccctccaacaccctctgttaccctgcaggcaactaggacagcatagagagcgtctcttgaacttgactttctcttccagtgcttgcctgccaatcccgtgacccatcctggagaacttttatagtcttcgacaatgcaatgcatagcaaccagttaataagataagacagtgactgtatagtgctccccaaagtgccatcacctaaaatagccctttgraaagtgcycatatagaactgagaattttagtgtagtgscaggctggatttgggtagggtgccyttcggtggscctccaaatcctatgggragcttaattacttcatctttctgtaaggccaacagttctcaaaatttgtggtctcaggmcaattttacactcttaaaaactgaggragatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtaagcttactcctccctcagagtccctctgacaacatcaggtaggcccaacaccacaggtaaggggggatcttcagaaaccccaccaacaacagtggacaaaagaagcatttgccttctccccaggcctgagatgtcccactttcacctagagatatcgaggtgggagggtagaacagacacgaggcataaagtgatggcaagcggcccagtctgggaaggctctgtctcagtgggtgtatgactgtcctctcctacccatagagacaccaacagtgcagggcgccagtagaagtgtcccaccatacctaccccaactgagaggcacctggaagcctgacctagggaaacctttctgctccttcaggcgatatgatctgggacaaatgtcagcctcagtgatatccgataaaccaaacagagcaaaacaatactgaaaattaaactgctgttagaacaacagaccacaaaagtaagccaacacctgcttgcatgtgaagcataaataatgtgactgactgcaaaaataaaaaatgtaaatatgagtttcctaacatagtagacaaaatgttcaatcaaaaatcntctgtcataccaagaatcaagtaaatcacaacttgactgagaaaaggcaactactgccaacattaagatgagttcgatgttggaattatctgacaaggatttcaaagtagccatcataaaaatgcctcaacaatcaattaacattatcttaaaacaaataaaaaaaaaaaaaaaaactcgag

SEQ ID NO: 2177 - DNA, 1201 bp, Homo sapiens
gatatggagagtcaattgcatttcattatgcccaaaggtaaatgcataactttttccgcacagctaatcttctagcaaccccgttgctgtccatggcaagcaggttagttactctcgccctttcccgtttcaggttcattaaaaaactcttgtcaaaatctctttcatcccatcttattcttcattctcacttccatcagcatatcagtccaggccctagtaacattaatgttactaatggcactgttagtaacattacttaccagcattcaagtgggtcttcctgatgccattctctcccatcctgaaatcactgctgtttatatagatcttgtatgatgtcattcattggctcaaaaacttttaaagccttcctttttctaccaccccaatctaaatttcaatgcctggcttttattaaaacccataatttggccccaccctagctatttaactttattttccactattcgccagtctcctccctcatcaacgagaagacataccataatcaacctcacctctaacccttggaatatctaaacttaaaaatggtccttccttycccctttactkgtatttaaagamcctgatgaattattcctcctctgctaaacttttcacaattcttcaacctcatttatgtttcacattttcagaacatatcttgccgtttattaggaatctcacaattaggcactctcatgtagatagatttacgatcatgtatgttgtcatcttctattaaattccatactccttgaaggcaggagccatgccttattctgtcccccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccagagtgatgaggtgccctataccagggataatggagacagagtacttgggattcatcactggggtcctcaaagcatcttccaagggcataataaggaaggactcaaacacctttgaatctctgtgagaccagtcatgaggtcttttgaaagagttctttaactggagtgaatgtcaaagagaagtataataaaaaaaaaaaccggcacgag

SEQ ID NO: 2178 - DNA, 1815 bp, Homo sapiens
  misc_feature (1360)..(1360): n equals a,t,g, or c
ggcacgagcgacaagccatccccctgcccttcctgcaggctgccttacccattcagagggaggccgaggctgtgccggagcggcccacagctgcgggaccgcgttccagggtgtgctctgctgcaagcatgagggaaggacagttaaaagcaaaacggaagccttgcatgggccgcttatgcttctggagctactttttttttttttttttttttactatacatggtatttagataaaggtctagagtaaaaggctctacaaccatcttatgttcagaggtcagtgtgtgacttaatttaacatttcctttacttttgtttttctccatcttgtattttatagccagagcctgaacctcctcgtcgattttttgtcgaccagtgggagctttctcttagtctccgctcctctgcccgccccgcctctccctccyccgactccytccgacaggtagcatggcctaggactcactaaaactctgccctccgcagcctccactcacgtcactttcgcaagtgtcatgtaccccaggaggctgcagtgttcctcacttgggcccgtctcctgtagggagccagctgcatgtgttgctgtttgcctgtgtcggtctcgtgtgtraggtctgtggcacactcctcagctaaagtggctgctggctttcatccaamtgawctgacacatccaggtctgttgatgtgaacccgctttgatcctatttcaactatatcaaataatgataaatgttttgcagccattggcttttttaacttcacatgtcttccaaaataatatgtgttaaaaagtaggaaccacaatgtaattaaatcacctcaatggaggggtgatgatgcggtattctggctgcctgttgtcatcatttgaggaatgtacgcgrctgtcacctgaagtagcgctggtccagttgtagggagtttctagagagattggaaggtctctttgccactcctactggtatttcccatgcctgagttgacgccagacctcacgtcctatgtgcatggtagcatatgcacgcgtatggtgtgcggcgggatctgaagtagcactggttcagttgtagggagtttctagagagattggaaggtctctttgccgcttctactggtatttcccatgcctgggttgaggcctatgtgcatggtagcatatgcacacgtatggtgtgcggtgggatcgatcccgcaattgccacatttctgctattttttatgagtgatgagaaggaaaccatcgcttttcatgccagaaacaaatagaacttgagtcttcacctctctkgcagggatgcttgtcagtgttgccaacttgctgagaactgaatgtggcagatgcctttgnacgggcagccccaggtttagttcaactaaacccagatggtttagttcaggagaaaagggtcctggctgagcagtgagggcccagggctggcttggtgtcctggcctcatacttggcatctggcccacactgccccgtgtctgctgcagaatgagagaaatgccattttctgctccctcagtgtcagctgttaagttacctgctcagctctgcctggtgtctgtctgtcccaagcctcagtttctttagtgtccctaaagaaggtttagatctgagagccacgtgtttgtcttgaccactaataggtataatctgtgaagttaatgggcaaatggcaccaatccttgggaatcttatttttgaattaaaagctataattgcttcttcagttcagctgagccttgagctgagccacaagaacggcttcgtcgtgtgtgcatctgtgagcccctcgag

SEQ ID NO: 2179 - DNA, 925 bp, Homo sapiens
ggcacgagcagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggatacccttagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcatctgtaggcgtgactgattaaactgttgtcctgccactggggatcaaattaaccttctgcctcttcccgaatgctgggrgggggggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaatttaaaaaaaaaaaaaaaaaactcgag

SEQ ID NO: 2180 - DNA, 921 bp, Homo sapiens
ggcacgagggcatgcctcccttgctgcagtacattccctgatcctctcaacaagctcacctctgtaagctgctggcctccataacctgctccaactcattcttcttgcccattggggaacacctctcctctgtcctgctctcccatatgctgcaaactcaccctctgctctcccagctcccagctcctgggcccaggttggtcgtttctcttgctttcctcctctactgcatagcacggtactgtcccacctgcaccatgctgcgttctctcagcaccacctgtgattctgccactggcctaattcgtgttctcaggtgtgtcctcccttcttgacctggccccgcacccactgctccaccagatgcagtcctctctgtgtcaaacgtactgcactgaatccacacgctctgctgtccaagctcacgtcccagtggcccaggctatgagtcctttccagggccccacaaccctgactcccctaaaccttcctgattcttttctcatcctttctttcacactgtgtaaaaacactctggggagcctctgcctctgaatctcctamcttcttcctgtcaccagagtagtttgtctttgtcactcattcgtgtcccactttctgcccatcctcgtccccccggtacgaatgcamccagtctcaacctgamtctcctgccctgsctgagamccagctcctctgctcctcctgggtgctcctgtcagtcccaccctcctcccacctcctccctccttaaggcccatgtcttcaagacgctctccttccacactgtctccatttccctttgcaccttccctccccgtgacaacagatcccctgctctctgctctcacccgcacagcccacttcctctgtgtcactgggcccctatcttggcctcactcctccacctgagtcctcgag

SEQ ID NO: 2181 - DNA, 979 bp, Homo sapiens
  misc_feature (48)..(48): n equals a,t,g, or c
  misc_feature (773)..(773): n equals a,t,g, or c
ggcacgagaatagggctacctggagcaaaccctggctccgtaggatgnatcctggggtttcctggctgctggggcggcagtctcgccctcccagtcggcctgcggttggtgggtgggggagggggcggttctcgctgccacggatccagaaggccaaattgaaccctcgttctgggatttctggctcctactcccgcaggccgcttgggtgactgtccttttttggagaggatatagagacacagctgtggcctctgcacactgctcttcttccaggctcaggaaaggccctcgcccaggatgtcgccactcagaaggccgagacccagcggtcttcaatagaagtccgggaggccgggacgcagcgttcggtggargtccgggargccgggacccagcgttcggtggaagtccaggaggtcgggacacagggttctccggtggaggtgcaggagsccgggacccagcagtctctccaggctgccaacaagtcggggacccagcgatcccccgaagctgccagcaaggsatgacccagcggtttcgcgaggatgcccgggacccagttactagattatgaaggcatctcagsccctggasccagagccagtcagggkttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctccccccycmtnacttaagtccaggaagctggggtggcgaggaaggatgatgtggattgtttttgttttacaccttctgttgaatggttgccaacacaaacttgagttctaataaataattgcatttccctaacgtctgtattttggaaggtagaggggagggaaaggcgcattcctccaacagcccagttctgccctgcgcagccctctacctcgag

SEQ ID NO: 2182 - DNA, 548 bp, Homo sapiens
  misc_feature (4)..(4): n equals a,t,g, or c
  misc_feature (37)..(37): n equals a,t,g, or c
  misc_feature (56)..(56): n equals a,t,g, or c
  misc_feature (548)..(548): n equals a,t,g, or c
tgtntgaaattgtgaccggattaacaatttcacacanaaacagctatgaccatgantacgccaagctccgaaattaaccctcactaaagggaacaaaagctggagctccacgcggtggcggccgctctagaactagtggatcccccgggctgcaggaattcggcacgagtgtgcatatatgtgcacgtgtgtgcgagtgtgcgtgtgcatgtgtatatgtgcgcatgagtgtgcatgagtgcaagtgtgcatgtgtgtatgtgtgcaagcgtgtgtgcacatgtgcttgtgtgtgcatgtgtgtgcaagtgtgcatgtgtgcgagtgtgcatatgtgcattgtgtgcgtgagtgtgcgtgtggtccgtgtacacatctgtccatacatgtgagcttgcatgcacatgtgagcatgtgagtgtgcatgcatgtgttgtgtgtgtacgtgtctgcacgttggtgtgtgtatgtgtgtgcctgtgagtgtgcagagaggccctggcgctcgagggggggcccggtacccaattcgccctatagtgagtcgn

SEQ ID NO: 2183 - DNA, 975 bp, Homo sapiens
  misc_feature (401)..(401): n equals a,t,g, or c
ggctgcaggaattcggcacgagcttcaatgaaatttatagaaaagactctcacaagtaccattgaatatagttttctgatgattttgagatcgtagtatttgactgggtaagaattccgaacttcagtgaaaaaactgaactcaaaaaactactaacccaacatcaagcagaataagaattattacatgggactaaagcaatgaaagattatgattttatgacttttttgtttggcacatggcttattctttcatgtttcattttccacattaattttttttttctttcagctatctacagtttacgggaatatgggaaggtgtacttttgtgtgcagaattgaaatttttttttctccctacctgatccctccagagtttggagactatttgtgagtatncttatttcaataacaatatagttatttgcttacatttaagaagaatctattctctttctaataggacacaattggaaacattggccatattaccaaggctttgcctgacatgtcctattctgagatatgaccagattgctctaaggaattaaagttgactttataaagccaattaaaaccccttggaaaatctatcttgatatcttggataaataattaacatggttgatttacaggtgagaaaaaatgtcacttcctgagaggccctggaacctgaatatatttttgggaaccttgagaagagaagtattcactcaagtttaaaggtattacaggcacaatttgagggtgactcctccttggattggcttcccagcctcaagaggctttcaaaagtttaatctgagattccttgtgaaaagttccagcaaagcaaaattgaaaatgagcttatatgattaatcatcattttgctgtacttctgtaaattattaggcaaagtataacaagcctaaaacttattttgcaaacaaattagttttattgtgattaactttggtaaaaaggggggaac

SEQ ID NO: 2184 - DNA, 481 bp, Homo sapiens
ggcacgaggaagaccccactcttccctcatgaaccatagcagataagttatcaccccttaccattaagtatccaaacccttattaatggaaatcatccattacgctgcccttgcaggaatcaccctacttactctactctttgccataggaatatatactgtcttgcctcctgggtggaatttcagacaaaaaaaactcaatattcgtaacctcttgcctcataatcctcctcatagctggtataatagccaccaccaacagatagtggcccctcctaaatgtcctgtctttgcccatcctggcatttcacactcttccttcactgcatcacagaaaacctttcatggtcctacccagaacatcccaccctcacagcattccttgattggatcaccaatcttatatttcaaggggatttacaggaattcactccagatgaagccgaattctttacctttacacttgctctctgtctattta

SEQ ID NO: 2185 - DNA, 825 bp, Homo sapiens
gcttacttggttcagctcatggactggcttcttaattctctgtatgctggccttttgtttttttccataaaagcacttttctttagtttccataaaatccattttcagaaaccagttgtgcaaagcatagaatttttttaaaaagatacctgcggatggtagaggggatggggaaagttctcactatgtggcaatattaataaatacagattaagtattgggtatctttgctatttaatatcctcaggctactcttcactgccctttcccaggttccctcccactgcacatcatctctctgactcctctttggtgccttccttctgccatagcttgttctcacatcctgagttttggatttcccccagaaattccaaactttccaactaggtcatacaaagcaattcagttctcttcagcctctattcgcaaactctccttttgatattcacactcatcctgttgcttgaaggaccctttatttgccataatcaatcttccttagaaagtagttattcaggctgggtgcggtggctcatgcttctaatcccagcattttgggaagccgaggcaggcggatcatgaggtcaggagttcgagacccgccctgccaacacggagaaagctcgtctctactaaaaatacaaaaattagctgggcgtggtggcgggcacctgtaaccccagctactcgtgargctgaggttggataatcgcttgaacccaggaggtggaggttgcagtgagccgatatcccaccactgcactccagcctgggcaacagagcgagactctgactcaaaaaaaaaaaaaaaaaaaaactcga

SEQ ID NO: 2186 - DNA, 455 bp, Homo sapiens
cccccgggctgcaggaattcggcacgaggttttattagtttccttggattgggtttcaaccttctcctgtatctcactgggcttctccgccatccagattctgattctgtgtctgtcatttcggacatttcatttctgggggagttattgaggtagtttgtggaggtaagaagacactctggcttttagagttgccagaattcttgtgctggttctttctcatctgtgttcactgattttcctttactttttgacattgctgtcctttggatgaagctatttgcttttatattctttgatgttcttgagggtttgaaggcagtataaattgtgtttagttgattgacttcatttctggatgctttcaggaggccaaggctcagcttagcactcctgagcttcatgctaatgccttggggactgggactgggcatatggctttgttctttgacctc

SEQ ID NO: 2187 - DNA, 811 bp, Homo sapiens
  misc_feature (5)..(6): n equals a,t,g, or c
  misc_feature (107)..(107): n equals a,t,g, or c
aggcnnccccaggctttacactttatgcttccggctcgtatgttgttgtggaatttgtgaagcggataacaattttcccacaggaaacagctatgaccatgattacnccaaagctcgaaattaaccctcactaaagggaacaaaagctggagctccacgcggtgscggccgctctagaactagtggatcccccgggctgcaggaattcggcacgaggctggaagtataatggaggccagttgggggaggagggggaaaagattcactctaagtctagatgctctagcacccacccaggatgtgtgcaaggaagtgcaggatgctcctggtcttgcaaactgtggtttgtgggactccaaagcccctatccttccacgatgctttctgtcytgttatcacatttccttggaggagarcccagccttggtggagagccctgcyctggctttgtccctcsgcatgagatggcaaaggatggtgctgctgggagaccctcacrtctgyrcactgggggctgcttgccttctccattcctccttcaagtatctgagcagctcctgtgtgccagctgctggtctacaagatggatsggtccttggagatcaygctgtagcagaggaggcaggctgtagcccacacgccacaaccagccccctgcctgttcacacaaataaagttttattggaatacagccacacccatttcagtgcatattgtctgtggctgctttcctgctacaatagagagttgaatagttgggacagagacctatggcctgcaaagctgaactatttaccatctggcyctcgag

SEQ ID NO: 2188 - DNA, 636 bp, Homo sapiens
ggcacgagccactactgtccaacatcaatttggaggttctaacagatgcaataataggaaaatattaaatgattgttataaacaaaattaaaactatatatctttttctggttatgttacagttcacgcggaaaatccaaaagattttaaagaaaaaaatctgctggaattagtaagataatttagaagatggcttgacagataatatatctgtcaaaatcgttttcccttatttccacaaaaagcatctagatatagaagcagaaaatgtttttcattacaagggtggcaaatgttacatggtgcctagaataaatttagcataaaaaaaacccagtcggccaggagcagtggctcacaccggtaatcccagcactttgggaggctgaggcagccagaccacctgaggtcgggagttcgagaccagcctgaccaacatagagaaaccccatttctactaaaagtgcaaaatcagccgggcatggtggcacatgcttgtaatcccagctacttgggaggctgaggcaggagaattgcttgaacctgggaggcggaggttgctgtgagacgagatcgcgccattgcactccagcctgggcaacaagagcgaaactccatctcaaaaaaaaaaaaaaa

SEQ ID NO: 2189 - DNA, 1132 bp, Homo sapiens
ggcacgagcttggagcacattgccaagcatttgtgccagttttttctacactggaaaataaaccctggcccatgctaatgaatcaggtcctaacagcaccaattggtctggttcttcttttgctttttgcattgctgacatttcctccttccagctctatcagggaaaggaattgatcatttggataagaaacaaaaaaaagtctctctctgcttcactgtgtctcttatgtgtggtgctactgtactgccttaggaacaagcatagtgtgtctatttttagggcaaatgtgcctactctatcttcgccaactaaatctttctacatgactaatttgcaagttgaattatcttggtaaataggctgactcactagcaaataatctgcagaatttatgcattaggcttctgtagtgaattaggtccttttgtcttgctcagcatgctgtaataaactgcagtagtgctctggttaataataaaaaaaaagaaaggcaaggaagagaagttattccaaacacatgaagagtctttctttagaatagttagttatgatagagatatatatagcaggttatattgagagatatggcaatgacttaagtcaaataaggaaatgaaccatgatataaatagatatatgcatagctgatgtgtgtatatgtaagatatgttttgtgcctctgtttgtgtgtgtatgtgtgtgtatgtttatctcctaaatgagttaatggaataatttatacttacataatcatttatcacaaaatgtgcatagcaatcagtatccaacagctagtagtcattcaagaaacatttgtaaaatgaatgaattgcaatgttaggttaacattctccattgtcagtggtcctccccttctgctgtccctactccctctatgcttgtggtgattcagttgcagaaagacacatctatacttcatagctgtagaaaaattctttttttgtggttgatttcatgtggtttaaaaagaatgccaaattatttgtacctacagggataatgaccgactaaatttttttttcatatatgtgcgtatgtgtgtgtctatgtctgtatgtatagtctaaatattattgtccaatcatggcagggattatggttgtatgta

SEQ ID NO: 2190 - DNA, 1062 bp, Homo sapiens
agcacgaggcctttggtagcctgccagcgcctccctcatttcccacatgtcacatgacttcttactgtccagccggctctgttcctcggttgtccctcccaagcacagtgcgtcctctcctgggatggctctattaataaccctcatgtggatgttctgggacggccattcatgcttcctgtcctcacgtctggcccccactctacgccattcatgagagtgacccccaggcgtggctggctccctccctttctccactgccagcgtgtctgcaggatccaaggtgccatgtgtttgctgttcacagtgacccatgagtgagaggcagcggcgttcacaccatagtttaagttaacaatgcccggctgggacgtgcgctgtgtggccctcctcggggactgcagtgtggcagaaaaaaacaccctgagcttcctctcttctctttctcctgctgatattttgctgcccctaacaatcattggatccaatataagctataaaaggcagcctcacaagtgctgagcaggggaggaagatggagaggggtctgcaggggcgactaaagattcccagcattaaaggcaactgctatctatcaaggatattcatccatctaacgggggtaataatttatcctagactgttgctaaggctgagttaatatagctgaagtgtactatcaaggttaatggcacccacctgagttcaaatctttgcacacatcctcacttaaatgtaaaaactcaacaaagaatgcaaatgaagccatgactcactccttcaacattactaggagacagaacccaacaaacttcaaataatctgcaggtagaaaaaaaccaccaaataccagcagaccttcactgcctctataggtcatgagcagggtcaacaggtcaagggaggcttaaaggactcagtacaggccaggcaccggggctcacgccggtaatcccaaccctttgggaggcaaaggtgggaggattacttgagctcaggagtttgagaccagcctgggcaacatggtgaaatcccatctctacaaaaaaaaaaaaaaaaaaa

SEQ ID NO: 2191 - DNA, 675 bp, Homo sapiens
ggcacgaggtttggaatttattttttgtctgtgatgtgaggtagggatcacccctcccccatattgtaaaactacctgttatatgcttttacatttgtaactgtttcatctagcatagcttaagtggtgatgggagtctgcttttgagcttcatctatgcattggcaaatacagttaattaactggtctagttttttatctctattttccttcttgcagatcagtgctcagagtcctaagtactgcctttcaggccccataatgtgcccttgtatcctctaacatgtctggaatttgcgtaggctgtgctggggcagggaaaggagagtttctttgtcacaacaaacaaggggaaagctttcttcctgtctcttcgatttaccaatgcctcatcagaaactttcagcacttatgtaagaaatgtatttattttcttgaactttagtatatttcgtttgttttacaatattgtagagtagaaagttgtttttgcttaaatatagtagttttttctttagtcctatacatttcttaagttcttaaatatgtttcttgatatttttagctttatattgtggtgttgtgtattctttggaaagggattagtgggctctgtgcaattatgaaacaacaaaataaggcacatgtgcatgttgcaaatatactcgtgccgct

SEQ ID NO: 2192 - DNA, 835 bp, Homo sapiens
ggcacgagctcgtgccgaattcggcacgagagaaggttcagtctcagtttagctgtagtctgctcagggtctcacacagctggactcaagatgtcaacttggagtgctatctcatttgaggctcagagttctctttccaggtcaattagattgttggcaaaattcaattgtttgaggctgtcagattgaagaacctattactttgctggctgcggctgaggacaatactcagcatctagaagccatctgcggtttcttgccatatgacctgttccagaggccatctcacactaccaatctctgacttctgtctccaacctccagacccagacttaaaagactcatgtgattagggcaggccactcaaatactcttccttttaactcaaagataactgattagtaaccttaattatagctgtacagttccttcttccacgttatataacataatcatgagaatgatttcccatcatacatcatattcagatcttcatcccgtacccttccttcctaaatatttcagcttcaagtggagggattgatataagacgtggatactaggggacaggaatattgggggccgtcttaaaattctacttaccacatagattttcataattattgtatcatcatagtggattatgaactttttcataatgtgatgcatttaaaaaatcacctttactgcctcaaagcttattttaaagcctgaaattcaagtttgtctgaattatgatcccaacactacttagtggttgtttacacttttttggtattccttttttccgtctttttatttgcaacctttttgagatactttgttttataagtac

SEQ ID NO: 2193 - DNA, 598 bp, Homo sapiens
ggcacgagcccattggcacttattggttccactggccagtccaccctacccaaggacagtgtcccctcctccattgtctgctgccatatttgattcctctctactctattatgggtcagcaggggcgggggcccactgtgagctttcctcatgcccttggcctcagccttctgagcagacacctgttcctacttgtcttggtgcccagggtagcaggaggcaaagtgcactcaggaccccttaactctaagattgtcaaacaacgacaatccccttggggccagtcattgggtgggttcatggttccttctgagaaaccccatatgcacttcattcttttcatttcccatgctctctcttttggcctgaagagagtatttttccttagaagaagcaagtagttaaaaaatattttcttcttttctttgacctagagcttaacaaaagacaaaactcagatgatgaagtacttaacatcttccttctttctttcctgctgacttgatgactctgctttggagcagtgggggcctcagggtcgcagtggagaaagccatgggccagtgggaggtgaaacggagccaaaggtgggagaggg

SEQ ID NO: 2194 - DNA, 1445 bp, Homo sapiens
ggcacgagtcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgcattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataagcctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattccctgttgaggtgttgttgtttaaccctctctccagagagcttcagtgggattgaaaaatacttgtccctggagctacagtaggaatgctctatgatttgtgcataatacatatgataatctgagctttaaattaatccctaacccttctggataatacgctgcaggtaatttctccttcctatattacattgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaaaaaaaaaaaa

SEQ ID NO: 2195 - DNA, 888 bp, Homo sapiens
  misc_feature (380)..(380): n equals a,t,g, or c
ttttttttttttttttttaggtcaaggtgagtttattgtccaaatagcataacctaattgcattcaaaaccattttcaaatccatctttaaactagtcagaaaacaggttattatttttttaaatcacttaacactgaacagataagacctcttaaaaggcagctgactatatcatgtcaccatcatagccaatacaacatttttgccatacttcctaaaaaccttttcgcatacactgatcatgctacttatcagcactttctaacatcctgaccaaacagacacccacacctcttatagagtacactgtgagagataacatggacttgatatggcatcacacttgttttaaagcaaaaaaaaaagaaaaagaaaaganaaaaaaaagtccaagacaagaaactatataactgagmgagaggagagagagagagatctgaggtacatgatataagggtgatgaacataatggaaaaaatccaatggcccgatgatttgctggggatgtaagagttggccagcmgttaagractaaacccaattaaaawwaaaatwgraactttgkttttcarggacaggcacctgtcaaaagacattggatactgtaatggctacagtcagtaaggcactttatttccccaaagtaggctgcaggcgaagggatgcaggctgcagctacagcatgcacgtacacatttgctgatggcttctcaaaacctgagccgagaatagggtctgatagcccagccaagtttaaaagcagacacacacgaatgtagtatcgttgtgcctgaaatgaccattctgggttgtttagaatccagaatcatcaaaagccatgtggtatgaggaagtaataaatatcctcttgaatcttctctcgtgcc

SEQ ID NO: 2196 - DNA, 642 bp, Homo sapiens
gattcttgtagtgccccccagtcccggaaggtgtgtgtctggcaacctggacttaccctgttaaacactggcagcatcatatacagtttctcttcttgttccttctgagtcatgtgccggggaggatggcacaactccgtgaagagccggcggaggtgcatcagtcctaaggcgttgtcttgtgggctgcactcctcctgcctcggccgccccatgatcctcttcaccatgttcatcttggctggttggtgagacgcacttctaattctgtaggaaaatgtcaatacatgaacagtcaaaacatcatcatcttgactaggtcaagcatgcatgtaagagcttataagaaatttgcaaaatagaaaattctgtctaaaatatatctttctacttctttaaacagaaaagacagagaagcaaaatttgataaatccccctgaagggcaaattatgaatctcagcattggaagttcttactcactttgccacaatttgtataaaatgtaaaacattaatcagacaagtaataaatgtttccaattagtttagtcatatcaagttcaaaaataaaggcgccgggaatagtggtgcacacctgcaatcccagcacttttggaggccgaggccggtgaatggctcgag

SEQ ID NO: 2197 - DNA, 826 bp, Homo sapiens
aaataacacatgcttttttyctcttagtgtttaggaggtcaaagtctaaaagcaaggtgttggtaaggctgcattccttctagaggtttcaggggagawttgtttccttgcctttttcagcatctaaaggrtgtctgcattctatggstcatggactcctcttaatatcactccaacttcttggtcccattatcacatatactaccatttctgatcccactaccttcctcttataaagactcttgtgattacattgggctcacccagataatctgagataatctccccatctcaaagtcgttaacttgatcacatttgcaaagtcccatttgccatgtaagataacatatgaaatgttctgaggattaaaacactattctgccaactacaatgatgaaggaaatatgaggaggaatactagatcttaggttgcaatgattttgaagactttttgaatataggcacgggaagcactgacctgctgtggcctggacttccatggttccttttttgaaatactagaagataagaatcattgatagccatcttagaatcgttctgccactatgtacatgtgtatgaatgtgttctcttgtgtgtgtgtgtgtgtttgtatgtatgtgtgagatatggttagtgcaaaagttgttgtggtctttgccattaaaagtaatgcaaaaactgcaaatactttttcatcaacttagtagttgttttcagtaggtctcataaatgtcttagaataaatttcttacaatggctgggcacggtggctcaagcctgtaatcctagcactttgggaggctgaggcaggtggatcactcga

SEQ ID NO: 2198 - DNA, 2099 bp, Homo sapiens
  misc_feature (644)..(644): n equals a,t,g, or c
gaattcggcacgagtgaagttgcaagttattttacttagatgtttaagaaaggtgatttctagaaagctagaaacttggggcactaggtttccaatgatgatacaactgctatttctattaaatgtctattctagtcccattgcaacatgcttgatatacataatctcctttattgctccaaacacatctaaaaggcagcattatctttattaccagatgaggaaaatgcttagaaatactttgataattagatgtttgtcttattttatgttcttgtaatagaagtatatttatttaactcttttttaccagttaattctggccttccttgacagtggaatttgaattggcatttggtaggcagatataatacaactggtataagttattgatkgataraakcattccaagaagamaatagaaatatttatgcaattccaaaatgtttttaaaatattaattatgcttaaaatatgtaagggaagagttcttatggcttatagttaaactaaactttttttataattgtatttcttgttttaaatcatgatgcaaaataacaaagagaatattgtgtttaattttttagtattaaatgactaaaagttactgggatttactaataagatttatgattcgcctnctcttaccatgttatagaatgagtagaatgagtgtttatttccaatatggtatactatatgcagcaaaaagaggctacgttagtaatgaataataaagtcagagaaagtcttcatgatgagcaatatttcagttgccaagtctgttgcttttcttaaatccatttatttttactattttgctactgtttccctgtggagggtttaatacttctattttcttccttaaccaactcgatagttaaagattatatggagaaatgtacttaagtgtaaatggaaatgcctggctgtgaaagtctattggcttttcttaaaattaggagaatatttatagtcataaaaaaaacagagatggttgattacaaaggagagtagactatgagcttaagtgagctacttgagaaaactttttgtcactttatcacatgcacatggcacaaagttgagttgtgatgtgctataatttgagaaaggagtgattatagcatctttctcattctcccgcccccagtacctgataactccccccactgaatcacttaggaagctcttggaattgtgtgcctgatgtacggcaaaactgtacctcccaggtcattgtggattcaagtaraagggaraggtgktcaagctgcctaaagacaaaacaggtcatagcaaaggcagagcttaagctagagatctaggcagatagagaagtggtgggggcacttgtggataggttgacagaactggaaccaaaatcttattcttaggtgggaggcaaagtaatttaaaatgatttggcagattgcagcaggatccccaagaaaagtctagatagaaacagtgcacaaaagtctgtttcgctgagcataaggtaagaatggagcaggccttcagatggagtttgagattggggtcttggtccaacaggactaatttccaatgggtcttgtggcttttccaagggcttacagcaaagcttacctcccaggatataaagggacaaaacctctttggactgacaatttctaatctccaaggaaggaggctggatctctgccctccagagaatggtctgggcatggttttggggagtgtttgtgaactrgcwgggyacaaattcctcctcggggtcattgcctccatactctatttttacaaaattctcatttgcgggtccaaacttctctctctctcttaggtcctgacagctagaatcttgacggtatattttttaaagatgctacatttcttaagcctagcaacatcttagttgtataaaaaaatgtacaggctgggcacggtggctcacacttctaatccccgcactttgggaggcagaggcaggcagatcacctgaggtcaggagttcgagaccagcctgaccaatatgatgaaaccccgtctctactaaaaatacaaaaattagctggatgtggtggcaggcacctgtaatcccagctactcga

SEQ ID NO: 2199 - DNA, 953 bp, Homo sapiens
ggcacgagagtgatttaaccccccatgaagatgaggatctggaaatataagtaggatctgaaactggtctgcagctgcatgcacagaaacaccctgtaatgctgcctttgtaataaggaggaatccatactctcaacagtcactccctgactctcctcttcctcttcctcatctttctgtgcatgtagtggatttactacggtttattttcattctcatcagttaggaggaaatagaagaaagagtaagtaactgaggttgaatatgttaacttactgggctgttttcattaagcaaataaacaacaataaaaaaaatctcaggctaaaatgaaccataggttccatttgtgaaatttgatgatacagataaccttaggttttcactactatctctatgtatatttcctaaatagcaatatcagcaaaacttcacaggcattggggtgggtaataatatttctttaaaatactcaggagaagtgaaagtcattcaaaggactttaattgtcatggagtcatccacttcccacttaactttttctgcctcaagtcccctctacgcagactgtctaaggcgtgatttaggtttttggaagcagctggtggcagcataaatctggccagacaaggagggtgctgtggaactggcagtacaccctgagtgcccgaatgtcacatgaaacactctgcaatgaagcaagcagggtctactaggtgccctgatcaatgtgaatatatgtaaggaaaggagaaaatgttggttcgtatatttaatttacagacatacaattcaagtgtggtttcaggcccagcatgggtgatgttagaaaggccttgtgcagtgctcctccaagtggggtctgaggcatctggcctgtggtctcactgctgacctactgcatcaaaacaagggaatgctgtttttcagtgtccctggtgattcttggtata

SEQ ID NO: 2200 - DNA, 1559 bp, Homo sapiens
gaattcggcacgaggaatatcggaagctccctatggcactgtcagtgtcctcatccccatcacccacaccatcatcctcatcttccttgaccttcttcttcttgaagagggagctgcgtttgttgtctgaggccagcttttccattttgtactcagacatcttctccctaagctccatctgcatctccttctccttccggccaagttcctttaggtccacattgtcagcaaagaggctgaagatgggcttgctggtccccctcactttgcttctgcaactttccgcgggtgagctcagtgtggtgttgcaggacagcacagactgcatgtcagagctgggtcttgcctggctctgaggcaacaggcagccacccaaggaggagctgctgtgtccactaagcatggagacttggtcatcccccaggcagctagccgctggtactgccttcatgcttgcaacagacggtgagcgggacaacagcagcatttcattttgcttctgagcaagggtctcactgactacattggcaatccagttctggatactggcaatggaaatggtgtctccaggccccactggcaggttaggcaggggtgtggtggggttggaggttgaacaccccgctatgttgcttgcagcytgagacaggtgggagcggtggctctgggtgctcagtactgacgtcgtgtccccatcagcgctgaytgaggggtctgcagaccagaacgcagacaggggaatgctcccgctggccgtggagctgtccgcctcccagcttgccatagactggctctcctccagcgtctgccggcttctctccagcagctccagcctccgttgtctcttcttagccaaggccgagtcctcccccttgctgagctccaccacctcctccttgttctcactgcccaccttcttctggtgtttcagcttccaggcctggtaggctgtcaggctgacgtcggaggggttcttctcccctactgcctcctctgcaccgggctcaccgctgctgtctcccgctcccaagtctttcttgtgaaatccaaattggattctcttgatcttccatctttccagggcagtgagcttgtccttgttcctgctgcagaagttgtagaaggaactggcctcagagcccacgctgtcctcatcatcctcccgcaccctgctccctgcttctgagctcctgtctgccgcctcctctctcttgctcttggcgtggtacctccgggaagcctccttctcaatctccagcagcctctygttccawgcgtcccaggtgctctccgaggacatcgagtctgcgcggcgcctcctgccgtggtccgggcggttcactccagctgctgcttcaggacccagatgtcgtggctgctcacgctctcccaggcgctgctctcgctcagggtgcgccgccgcctccccaccgaggagccagcgtcgctctcctcctccttctcctcctcccttccccacctccggtacccttctgcttggtacctctcgtttcggctctgccactcctggatgatcctctccacgtcctcgtcctcga

SEQ ID NO: 2201 - DNA, 608 bp, Homo sapiens
atgttgtgtggaattgtgagcggataacaatttcacacaggaaacagctatgaccatgattacgccaagctcgaaattaccctcactaaagggaacaaaagctggagctccaccgcggtggcggccgctctagaactagtggatcccccgggctgcaggaattcggcacgagcagctgcagggaaggaaagcttcccggggagaggagggaagtgtttttcttcccttcctagtgacccccatccacaaggtaggaactgcctctcctggttccatcattggagtcccccccacaagctgccccagcattcaggctcctcccaaggggcctgacaggagctatggagagctgcggccctgatctctttcttcacttctgaatgagtccatttctacccttttgggacccttagagatgtttggaagagtttggaggaggggcactaaggtatgcacaaccagatgcttgcagagtgactgggtcagccccagcttcaaagaggctatatcagtctatccccaaaactgaagtcccttgtagattttttctttctttaaccagtattcacatatttgtccctctagactaccaacccttaggcctcgag

SEQ ID NO: 2202 - DNA, 1157 bp, Homo sapiens
ggcacgaggttcatcctccccctgtgcctgaacacatttctgttctgctcactgaatgacaggcagagaaagggagagaaatccccatagaaagaagagcatacagccaagtttgcgttggctgtgctttctgctctcaatattcttagcctgtcttaacaatcattcttctgggtgggcatacatgcttttctttctcatgaaaaactgggcatctcagagcacggactaaaacccactaccaaggctgtgcctgcatctgactcatcaccctcaaagccctcctcatcctcctttctcattccctcattttcctcactagccttggtagagcactttgcccagcatggtgcttggctcatcattaagcttcctgaaaggacccacatcatcatcacttcctccatgaaggcttcaacaacatcccaggctaagttgctctgtgtttccacccagtgctcccacatcctgttttgcttatggctggcaccttttaaggaaaatctgtttacctatccatcttccacaactctccattcccagcacacaaacactgtcagtcaccagcagccttctctatctttgtgtctccatgcagtagaatcaaagaaagaattggttggattaattcatctatcaccaagggcacacaagggagccacggagaattagaaacaagcagcttcgagtcagacagctctgaatgtaacccctttttttacattttcaggtagaaaatcacttaaacctttagattttcaatcacctcatgtgtgagtgatgtcaatcaaggaaagtgactgagacaagtctcagtcattttaggggtttatttgcctaagttaaggatacccaggctgggcgcggtgggtcatgcctgtaatcccagcactttgggaggctgaggcgggcggatcacctgagatcaggagttccaagccaaccaggtcaacatggtgaaaccccgtttctactaaaactacaaaaattagccaggcatggtggtggacgcctgtaatcccaactacttgggaggctgaggcaggagaatcactggaaccagggaggtggagattgcagtgagccaagatcatgccactgcactccagcctgggcgacagaggaaggctccgtctccaaaaaaaaaaaaaaaaaaa

SEQ ID NO: 2203 - DNA, 742 bp, Homo sapiens
ggcacgagtgtgtaggtcacatttaacaccagtatgaaagttagaagatgaaaatactaacagtaagtatagttacaataattttaatgtgtgcacttaataaaaatacataaataaggacaatatcctttccatttacattttatatatttatgttttttcatgttctatttagtgtcttttttgtttcaacttgaagacctgtatttagcaaattttttttgtggtaggacaggcgtataatctttacctctccatttctgaatgtcacttttgtggagtgaagtactcttggttgacagacttattttatttcagtactgtgaatacatcatccattatttctttcctgcaagatttctgctgacagaatactgatatttttctgcagcttcccgtatatgtgatatttcacttttcttctgctcctttcaaaaatatcagtttgactttcatgttggataattagattataatgtgtctcagcacagatctcaaagtgttcagcttctttggggttatttgagcagcatggatatggatgtttattttcctttctagatttggggaattttatgttattagttatttaaataagattttcttcccgttttccctctctgctccttctagaacttccataatatagatattgtttcacttgatggtgtgccgtaaagcaagtaacctttcttcattcttttttctttttcctctgattagataattcaaataatgtgcc

SEQ ID NO: 2204 - DNA, 303 bp, Homo sapiens
ggcacgagaaaatttccatataaagaagggtctggtgtagaaatatggtgaagggttgcaagaggttgctaaaggttgttaacttgatgtttcatttacaaaataaacactctgtttatacttagtgtattacactttcgtattgcttgccctgggaaatatgccagggttggctgtgactagcccaacttgggttgttaggttcactaacaatccagtcactgcggccagcaggatggaccatgctgcttggttagtactgatctcaggctcatccctggaactgagactgaggtcagcccc

SEQ ID NO: 2205 - DNA, 1162 bp, Homo sapiens
ggcacgagctcccctgtgtttccgaaatggggaaagaaaggccaggcgcagtggctcacgcctggaatcccagcactttttgggaggcggaggtgggcagatcccttgaggtcaggagttcgagaccagcctggccaacatggcgaaaccccgtctctactaaaaatacagaaattagccagccgtggtgtcaggtacctgttgtcctggctactcgggaggctgaggcaggagaatcacttgaacccggaaggcggagattgcagtgagccaagatcatgctgcagtactccagcctgggtgacagagtgagactctgtctcaaaaaaataaggaaaaagaaaaggaaggaaagagcccacctcgctggtttatgagcctcaggccagtaactcaaactacgtttggagactgtggctctgtttctagccacaggggaaaaaaacctatgaacaaacaggcacagcccctgcctccacgaagtgatgacttcatgccgcagacagcgaaccctcacctcccaacagatgcctcagtgactgcgggggaaaagccacgaaacagagggccagatgttgagactgaaccattcagggcctgagctgtctggaaggccggggcaggtccctgaggtggtgagttgggaaagagtggaacattccagaaagcaagagcctcaggtatgagtgctctgagctccaggggttcatcttgtcctctataaaggggggaatgacacagcgcagttgctggggaaaacagtggggttcctcaaagagtcacacacagagttactgtcattaccaaccagcgactccagtcctagggatctaccaaaagaactgaaaacaggcactcggcaaacacttgcacacacgtgcatagcagcatgagtcacggcagccgaaaggcgcaaacaactcgatagccatcaatagatgaatggataaacaaattgtggccgggcacagtggctcacgcctggaatcccagcactttgggaggctgaggtaggaagatagcttgaagccaggagtttgagaccatcttaggcagcaaagtgggatgcccatctgtaaaaaaaaatttttttttaattagctgggcatggtggcacacttgtagtctcggtggctcaggagactgagggaggaggatctct

SEQ ID NO: 2206 - DNA, 759 bp, Homo sapiens
ctcgagttttttttttttttttttttttttttttttttttttgagacggagtcttgctctgttgcccaggctggagtgcagtggtgcaatcttggctcactgcaacctctgcctcccgggttcaagtgtttctcctgcctcaacctccccagtagctgggactacatgcacgtgccatcacgcccagctagtttttgtatttttagtagagacagggttttaccatgttggccaggctggtcttgaactcctgacctcaggtgatccaccctcctcggcctcccaaagtgctgggattacttttttctttatttattttggcttctgcttttcacatgaggggcttttctccaatatctgatgatccttcattgtccattcatcttcacaagtaaggcaccaaaatgctaactggaaatcacaaaatctctgtatgcctaggcaagcttgtgaactaatgaagcatcactgcaggatggggaagctaggtgttccactggagcaggggtccccagagttcagtatctgagatggtttctcttgggctgatcagtttctctgaagatgaagggtgcaacacatatgaaaatgaatcaatttcatcttcagagctacctgatattttcgattcctgatcctttctgaagcctacctgagtcttctgaggttctgtggaataaattagtttgctccttggccctaccctaactccacacacaccgtgcccacatttcagctttctcttgtcctcgtgccgaa

SEQ ID NO: 2207 - DNA, 933 bp, Homo sapiens
cggcacgagctcgtgccgactgtaatggtcccgtcacacttgtctgatgaggatctgttggttgactttgacagtgataaacgaacacagcctatctgggtgttttttgcacttatagtttgggggtttgaagtactggctagaagctggcggggtgtgtgtgtgcaggtgtgcgagtgcatgtgcaacgtgtgcgtgcaagtgtgagtctgcacttgtgtgcaagagaatgtgtgtgtgtgtgtgtttggagatttggacttgaaaattctagctcaggtctttggggtagtgtttgacctgaactctgaaaggcaagggtcccagactttcctgggatgatgggaactgggcaccccaatgagctcggttgtgagtagacggggtgggccaccgaagagaagacagagtgggcctgtagggccagcccgaggtacccacagtggagggtctacaggctgatttgggaggtggtggtttatacctgtagtcaccttctatcttagttaggaattcaccttcacacttccagaaactgccaagaagaatgccgccgctcaggtttatctggtagaataagctgtttgaacaaagatctggaggttgcacaatcctgtgtcattctggatttatcttggggtcgggagtcaacgatacttcttgtgctgtcgtttctccggccgtgtgaagttaccacctcgtgagtggtcataagttagcgtgtctaaatgcactttgaaatcctaggatgaaaaagccaggccctgtcttttttccttgtctaagcaccatccttgcttaggagagacacggctgtggctctcaggctgtggggcaatgttctgcttataatgtttcaagaggttcaaagcgtgcaggccccatgctccgtgagagccttgacctgggtcagcaggggcggctgggcttgac

SEQ ID NO: 2208 - DNA, 655 bp, Homo sapiens
cccccgggctgcaggaattcggcacgagaagatacgacgagattaaaaattttgcctaaggtcacacagctaatggatggtggaagtaggatactaactcagacagtcctgctacacacagatatgcaaataatcctgatttatagttatttggtcagagggatggattgtatattttatgaatgatttcagaccctcttctactccctcttactttctttctgtttatatcactgtcaattaactttccagtagtagaggctcagagatggtaaaactaccactaaatttatagaaagttgtatgaatttctttaagaagtgggaatacttctcctttcctcagttttttcctatttatggtcattgcagtaatttctatcatcctttgcagctttgaaatcacttcttcacatgtaaacagctcaccctggtgttgccatggagatttatatcaatgccatgagccagggcctaatttgcgcattctgctgattaacaggagtatttgctaatccctgccaagctctctcatccactgccatgactaatctcaccggttggcgatgcgtggaattcatgaatgctagaaacccatcatcttaggttatttaacacttcaattctgttcagtaacaacttaattaagtctcgag

SEQ ID NO: 2209 - DNA, 366 bp, Homo sapiens
ggcacgaggtttaacacctcgcagtaagggattcttcacatcccagaagtagctaccctgcatcttaaacagtatgctaggttagattcttgcccgtttgctgttcctgataatgccctttaactcacacaactgagctgttgttagttaggatctacggccacagaaatagtatgtctgaaataaacataaatatgagtaaaatccaggcataccccctaaatcatgcccttcactttcttcctgtttgtaaatcttttgtaagccttcaactttttttctttttaagcttgtagccatttctttttgaatgactcttagcttactgtgtttccaggggttgaggagccatgtatctgtgggata

SEQ ID NO: 2210 - DNA, 621 bp, Homo sapiens
  misc_feature (616)..(616): n equals a,t,g, or c
attcggcacgagggaggaaagagggtggaatctggacagtatgaaggatttgtattgtacctgtaatgtttgatgtctgaagctgggtggtgggcatggctgtttgttattctccatccttttggtatgcctgatacatttcataataattttaaaaaggacaagactactgcagagaaatgcatagagtgagctctgtttgggtttttaaaatgattcctacatctatgcttgcagatgtaagcaccagccctggaaaacattgcaagggattcttagtaggcccaagctttgggaaagggccaagggggctggggagttgattaggaggggatacatgctttttcctgctgccttttgaattttgtaccacacgtagtattacttattaattaaaaaataatctgaactagccaggcgtggtggcacatacctagtctcagttacttggaaggctgaggcaggaggatcacttgagcccaggtggttgcggccagcctgggcaacatagtgagaccctgtctctttagaaaaaacaggccaggcatggtggctcacacctgtaatcccagcactttgggaggctgaggtgggtggatcacctgaggtcgggagntcgag

SEQ ID NO: 2211 - DNA, 1611 bp, Homo sapiens
agtacaattccttttcttgcacagacattttcccaagtcagtacatctgggataatagttctcagagtggctgtatattatattcacatgaagagattttaaaagttataccccatgttcatcgctttatgttcaaaagtgtgtgtgtgtgtgaatgcatatgtctgtgtacacacatatgtagtatttatgcctggcatgtatacaatatgggtccatatatgcaactgagcaggtattttagaacatctgatgaccttgtcatttcaagaactgtggccacagattgagaaataaagcaccctttcagtagtctgagtatttctcaacaaaagtagagacttgcccatccttagtcatttctatggraggagtggcctctcattttatgcttttatagggacgtctattcccagcccatagtttatgagcaacattctstcagcaggcwkgaatagtggctcsctataattaattcccttcttgctcccccacctctgagagtgagaaataaaagggcattaaagggaatgtagttacaacccacaaagggaccacataaaatgtcaccttttggctcaacacattgttcccttcgtgactcctagtcctgaatttccatctcacagggcaggcagagtgtattgtcagctgagacccaagagagacacattggcagtcaatctgcatgatatggtaggggtattagttaaaactttactgaaagttaagatctgtgtcaaaggtttttccttgtcctatgtgcattacatggaagacagaagaaaacaaggaaaagagatgaattgctgttgcaatttaaagtatgggggcagagagttgagtgtgagctgcagaatttctatgtgacaacatagaatagtggtgaagttacttaacttttgtgggcttcagtcctcctgcctccctttgtagcattagcatcataatacgtgtctcccaatgtttcagggaagagtaagtgggtttagatatatgtagtgaataccacagtacctgacatatagtcagttctcagtgctgataatcatataaattgaaagcaattaaaacacccccatttatcttcccatgcataatttataaagcacattcacatcatgcaaattcatcctcacaacactcaacattcaattaagataagcatgcactcttgtttccctttgcacaacttttgcaagttgaatggctggtttggttagattcaatccagtgttctttccattagagcagctgccacctagagaagaggacaatgtttctcccagccattgaacatgctgcatgtctctgttgaggggccaccatcaaaactcaggccctgctgttctactctaggaggacagatggtcttaaggaatatagggaccttctagaccggaatcctcacaccaaacctttagtctatggtaatcactgtttacaaaagtttaatcttgttcccttctttaaaagtttcagagcattggtgtttattgacttttttgtttctttaaaaaagaggacaagccaggcacggtggctcacgcttgtaatcccagcactttgggaggctgaggcgggcagatcaccggaggtcaggagctcgag

SEQ ID NO: 2212 - DNA, 1267 bp, Homo sapiens
tgcaggaattcggcacgagctcactttgaccatgcgatcccttggcctgagatgcgctttctatcttctctgtctgctcaatccctctgccctcccagacccagctggaaggtcacctcccctgtgaagtcttccctgactcccccagcagaattaactgccccctctcttgggcttctggctccactcagtttgtcacaggcctgatgagcaaggatatcttgatgaaggtgataactggccgaaaagcagttggggcgcccaatggcgcagcttcagaagcaccttctgtgtttttggaactgttggcagcatcccaaggtgaaatggtagaagcatatggcatgggagaatggaatggggaaggatagggagtggaggttcacagtccattccaaggctgtatgtcaagatgacaggaaacacatatgcagcttgtctcaaagttgtatcttgagactggggagaaagaaggaaagaaaacaaggttttaaaatgcagtttgaagccaagctgcctgcttacagtcagactgcctggattcaaatggctaatttctaccacttcaactgactagctctgtggaacattccagaatttctctattcttctgtttcctcttttttcccccttaatttacattttttgtgggggggcaggtaagagacaggatatcgctatgttgcccaggcacaccttgaactcctgggcttaaacaatcctcccaccccaggcttccaagtagctgagactacaggcacctgccaccacccccggctggtttcctcatctttgaaacaggaagaaaaacaatagcaaccactgttggagttttaggagaccaataaacactctttctgccccttctgagttcagaactaaggaagaaaagcaggtagagatcaaaatgtcatcatcattgctgacaagagctagactggaggatgtggttgaagtgaaaatactttacccccagtcactaacacagcaactgcagacagcccattaccagggtacagggcggtccaacccagcaccccaccttctcagaaagttatcagtcagagaaatcctcctcctgctctggggaaaaggagaatgaaagctagatagacatgttcctccacacttggccccgctggggaatggaataggaatctcctcctgtccttgaaaatatgagaagcaaaaataagtgattctctcaataccattttatgggctcttgaggttgttatgagattaaggaaaaacacagctaaagtat

SEQ ID NO: 2213 - DNA, 1341 bp, Homo sapiens
  misc_feature (872)..(872): n equals a,t,g, or c
gtttccatttccttgagagatttttgttcatccctttattttgagtctatgtgtgtctttgcttgtragataggtctcttaaagacagcataaaaatagatcttggttctttatccatcttgccactctgttttttgaccagggcatttagctcatttacatttaaggttagcattgttatatgtgaatttratcctgtcatcataatgctagctggttattttgcagacttgtttatgtggttgcctcatagtgtaacttgtctgtgtacttcagtgtgtttttgttgtggctggtaatagttttttctttccatatttagcacttccttcaaaggctcttgcaaagtaggcctggttgtgatgaatttcctcatcatttgcttgtctgaaaagggtcttatttctcattcgcttttgaagtttagtttgsccagatatgaaattaagggttggaaattcatttctttaataatgtcaaatattggcccccagtttcttctggcctgtagggtttctgctgagaggtccactgttagtctgatggaattccctttgtagatgacctgacctttctctctggttgcccttaacattttttctttcattttgaccttggataatctgattattacgtgttttggggttgatcttcttgtttagtatattactggtgttctctgcagtttctgaatttgaatgttggcccacttttctaggttgaggaagttttcctggatgatagcctgaagtatgttttctaacttggttccattctccccatctctttcaggtaccccaatcagtcataggttcaatctctttacataatcccatatttctcagaggttttgctcattcctttttatttgnttttctctatttttgtatgcctgtctcatttcaaatagttttcaagctctgagagtcttttccctgcttgttctattctgctactgatacttgtgattgcattgtgaagttctcgtgttatgtttttcagcttcttctggttagttatgttcctctccaaactggaaaatgctatggttctggcaggcttgtaaaggtgctgtgctgatggtcttagacaagatctggaataattatttggattatcagacagagattctcattctttttctgttactttctctcaaacaaatggagtctctctctctctgtgttcttagctgcctggagttggcagtggagtgacacaagcacccctatggctactgccactagggcggcactacatcagatctgaagacagcacagtgctgggtctcacccatggcctgctgcaaccactcctggctactgcctatatttgctcgag

SEQ ID NO: 2214 - DNA, 372 bp, Homo sapiens
ggcacaggaaaggaagaagatgactgtcccctaaatcaaagcccaccacagaggacctgagcaggtcccactgttgcagactgcctgctctcaccagctactgggcatcgtctgactcagcttgggagggcccaagtgaatggtcatcagattgagcaactgggcaccaacatgtgtttcctgagggcctgctggtggccagctctgtgcttgaccatacagcaggagggactggaaaaggggacaatacagtgcctgtgcttggggagctctgggaacaaaagcccacccattaaatagtataatacccccaggtgtttctggcaggggagatgggaaaagtagccattttgaaaaacagccagctggggg

SEQ ID NO: 2215 - DNA, 745 bp, Homo sapiens
ggcacgaggacacaaaaagcattaaagtattaagtaatggcaactggaactttaacaacccttctgtccttctgtagtctgttgatatagattggatgtgtgtcctctgcagatctcatgttggaatgtgatccccattgttggagctggggcctaatgggaagtattggttcattggggcacatcccacataaatcgcttagtgacatccccttggtgataagtgagttccttctttgagttcatgcggggtctggttgtctaaaagagtatggcacctctccccagctctctcttgctccttctcaccatatatcatggtagttcccatttgccttccaccatgattgtaagtttcctaaggcctcaccaggaacaggtgccagcaccatgcttcctgcatagttgttcactcttattcttcagaatggctactgcaaatattgtccagatgtcaaagctccctactccactctgtgcccctcctacactcaacttgttaactctttgctcccgatgcaaactcacttgtcctttctgtcaccgtggatgtctctctcctcccagtgcagttaccctcctgtgatttggtttccatttcctttcctttcattaggaactttagatcattcatttaaactctcctctgtgtccttaagtttttccactagtcattggtatcgacattttaacatgctcaagtctcctctatttctccctccctccaaaaaaaaaaaaaaaaaaa

SEQ ID NO: 2216 - DNA, 1203 bp, Homo sapiens
ctcgagctgcagtgggctccacccagttcgagcttcccagctgctttgtttacttactcaagcctcggcaatggctggcgcccctcccccagcctcactgctgccttgcagtttgatctcagactgctgtgctagtaatgagcaaggctccgtgggtgtaggaccctccaagccatgtgcaggatataatctcctggtgtgccgtttgctaagaccgttggaaaagctcagtattagggtgggagtgacccgattttccaggtgctgtcacccctttctttgactaggaaaaggaattccctgaccccttgcacttcccaggtgagacaatgcctcgccctgcttcggctcatgctcggtgcgctgcacccactgtcctgcacgcactgtccaacactccccagtgaaatgaacccggtacctcggttggaaatgtagaaatcaccggtcttctgtgtcgctcacgctgggagctgtagactggagctgttcctgtttggccatcttggctccacccccatttgtgtgctatttatggtaacttgtgctgatgactctgcgatgtgtattccaaacatatgtatggaatagttccatttttaaaagtactattcaaacagcattgtcctcactctcaagtttgtcatctgaattaaactttacttaatctagtatgaaaactycttgagctataaaaaagtatgaccttttttgttataaaagctatagtcacatcacaatagggctatataaattaacaaccatatttcagaagcacttaaagcataaacatgagcccttaaatatctaaataactggggtcttttaataattcactgtatcaaaccctaaaaaaatttgattaatcccaagaaatcttcttctgattgagtaaatcaaataaatattttcaccatgaaaaagatcatcctacaatatctatttgtgagaagtttagtgctttagatattagggccactctacttagggaaagatatatttctttttctttttttttcctttttttttatttttttgagacagagtttcactcttttcacccaggctggagtgcagtggcgcaatctcagctcaccacaatctctgacttccagattcaagtgattctcatgcgccagcctcccgagtagctgaggctacaggcatgtgccaccaggcccaactaattttttcttggggccg

SEQ ID NO: 2217 - DNA, 722 bp, Homo sapiens
  misc_feature (598)..(598): n equals a,t,g, or c
gaatttctggagtttcaggagctttatcctaaggtggctgtgataacctggattgttgtgtaaattgcacatttggggcttggcaagtggcagatgggagttctggctgttttattaccagtaactgggacatgggcttgggttcgaggaggccacgtggctcctgacacagccttaaggatctgaggtggcccctgccctgggcacctggggtgggaagggaggtgcagggaacagggagacttatttttcactgtgatcttttcgaaccatttgaatgtattataccttgtgtgttttattcaaaaatgggtagatttgttaaacaaaacctaaaaaaaatatgagcaggagtgacagaaaacagagaccactgagtctgagtccaggttggcccctcccggtgtaaccttgatgcaacattgagcaggcctgagctggggtgacctcactgacagctaggagaggaatgagactctcctctgggtcactcggtggtaggggtgagctggggtggcctcactgaccgctaggagaggaatgagactctcctccgggtcgcttggtgtaggggttcagtgggaatgggtttggggcntctgacatatctggctcaggaagccagggtaaatttcagccttaaaggagaaaggctcgtgtcagcccccacagtctgcaggggctgtccctcctgggctcctctccacccctggtgatgtgac

SEQ ID NO: 2218 - DNA, 252 bp, Homo sapiens
ggcacgagtttgagccacatgaaagtaaagctgccttttgtgtctgtgtcactctgtgtgtgtgactgtgtaaggggtagcacacttacatggaacaggttactgcgtgtgggagaaggctcaggaaggtattcatatttatacagacggaaagctgggtggggttgcggacacactcccatagagaaggtggtgtgagcttgtctggcaggccgtgaataactttcatatggctcaaaaaaaaaaaaaaaa

SEQ ID NO: 2219 - DNA, 1195 bp, Homo sapiens
ggcacgagcgaccactcacaggtgccagggctctgacatctcgccaggcatagctaaaggttatactcatctatccccttctgcttctgttacttttggtgtgtggaacaagacccatgggagctggtgcctttggctacttggccttgccttgtctggtttgcttgacatatctgttacctaccttatctagaaaccattctcagatgggatgataaattaagagaacttacactcacagaaactccaaaacaattccaactgggcttttcttcatgttgaatcataatatactgtaatgatttactaatgaaataccattttgtttatcaaattaaatgagcaaatttaaaatactgatagccaagtgtggtggctcatgcctgtaatccccagcactttgtgaaggtgaggcaggaggatcacttgagcccaggagttcgagaccagcctgggtgacatagtgagacaccatctctacaaaaaacataaaattagccaggtgtggtagcatgcaactacagtcccagctactcaggagactgaggtaggaggaccacttaagcctgggagatggaggctgcagtgaggtgtgatcatgccactgcactccagcccagtgaaagagcaagaccctgtctcacaaaaataaaataaaataattgatattaccctttatacatggttgttgaaatagggtggtgcccttttggaaaatcacttgacagtatatccagaaatgctgatatgttttcacacaaaaactttgttttactttcagaaatttatcctaaatcttggccagacgcagtggctcatgtctgtaatcccagaactttgggaggctgaggcaggcgaatctcttgaagccaggagttccagacaaatttagcccatgtggcaaaaacctgtctctactacaaatacaaaaattagccgggcatggtggtacatgcctgtaatctcagccactcgggaggctgaggcatgagaatcgcttgaacctgggaggcagaggtttcagtgagccaagatcacaccactgtacttcagactgggtgacagagtgagactctgtctcaaaaaaaaaaaatcttaaatctagaaaactgtagatgtgccaggcatggtggatcacgcctgtaatcccagcactttgggaagctgaggtgagtggatcatttgaggtcaggag

SEQ ID NO: 2220 - DNA, 1347 bp, Homo sapiens
ggcacgagaaattttcaggatgccagcttcttagaaagcaggctctttcccagtgggtttcttacaatgaaaacaaccaaaatataacatagagctcattaaccttgccagccactgtgctaaattatttgtatttattttattaataataattatttctttcatcttaaaaataacctttaacttattaagaatgcatgcttattggatattctttagaaaatatagttcaacaaattcagccataatttcacccccagagagtgtcattcccaacgctctggtttaggatggctttggaagctggagccctatacattgggtggatattaggccaggcttttttttttttttttttttcagaagtttcccttccaaaatgtgggaaggtctagtagtttgcttggagagaatcttttctgttttcttctctctcaagcgcttgagtataagacctagttattgcctgatttgaaaaactgtatttgattaaaaagccctcaaaacgtggtcagttcagatgcaactgtgggaaagaaaaatgatatttttctatttctgagaagcatgagttgagggctcaacacacggtgaatgcccaggagccgatgttaaacaactgaaaagatcaattgaaaagaaggatccccaaacacaatttcccctgacttaatatttcaactaatgaagtcaaccctgactgagcacaggttacatgccaggcacagggagggcgctggaggctgctgcatggcatctacctgtgtgtgtgtgtgttgggaacacatatgagttcatgtgcagcggtgtgtgatgtgtgtgtctgagtatgtgtgccagtgtgacttgtgtgtgcgaatgtgtgttcatgtggttgaatgtatgtgtgtgtgcaagtgtgtgaggtgattgtatgagtgtgttttcacgcatgtgggtgtgtgactgtgagtgggtatgtgtgtgtgtgtgtgtaggaggagaggaggagatgcaaagggaaatagacactgctatgggagcccagggggcttgccagggagagtgcacgagacctgcacatagcaccctcttcctttgatttgcaaagccctctggacctcccttcctgcctcttttcctcctctattgctctaaattctgaaaccagaattgcttggggttcctcatacaacctcttgacaatcccacccttccaaaggaggataaactgactttcaaagccagtatccccaatctcaagtcctggtctctcaactggacttggggcaaaatggttacagagcatggtaggcagccttcaagatggctgtctctgaaattcaggctcttgtgggattccttccc

SEQ ID NO: 2221 - DNA, 794 bp, Homo sapiens
ggcacgagaaaagtttcagttctggggatgattttgttcctattcttgataccaagcgataaaatcaggctgctaagagaaaatgaaaaggaaatagccagctagtgtcattgaatcatatcccgaggcagtgagtttcttccagcacattttggcctcagtcctgaggctggaccttaactagtgaactgcaaactcactcaattatgcagtctgcttggtgcgatggaagtgaaaatgtcctagagagttgggtgctagtatgcattttgatagtctcctagcctgtgacccaggacagattccttgcatgcataggagtttgtcaccatgcaaaatctggctgttgttcttctgagaacatgggggagctggactgtcaacaatgagccatatcaggctgaaactgggaaactgttctgctccttcagagtcaagacaagccagaatgagtgtcaaatttccttcctctgtgcttcctcagatgtggtcagattcatagccttcagtctattctaattggtagctagcctggtgtggacttttgaccacccaccaatcaaccaactcccaccctcaccatttactgcacgagtaaagccacgcttcctaggaactaccattggtagagatgttactgagtcataggccctgagataggaatgatctataaaggccatccacgccagttcttgaacccttctacaacagtccagactcatctttgcccaatctctcctctgacaatgaaagccttaggaccaaaaaaaaaaaaaaaaaaaaaaaaaaaaaaa

SEQ ID NO: 2222 - DNA, 1184 bp, Homo sapiens
  misc_feature (467)..(467): n equals a,t,g, or c
ggcacgagcagaggctgattctctgtaatcctaccctccccttctccccatcagggcccttcttagcactctgggtggttgctccaaccatgcacctggaagcttgggcttgggttacaatgctctgtttatgtgtttgtctcccctgattgcctgccagtgattcttccttctcatatctcagcacttaacatagttcttgawatatattaggtgataaaaattgtctcttcttttagcactggagccatgagatacccctgagaagtggtgagcttgtggcgtgaagagctgggtgacctcctcttccttttggtggcctgagccagagatgtcacttcctcacctgctcttttctgctttcatgtctcaagctgcctgggggcttctttttttaggtctcttacactcgactaatctgcgatgggcctagaacccacaatggggaaaggacagactcttcaatncgcaggttgggaaacaaaatattcacctgcagaagaattaaattggagccttgtctcacatcttatataaaaatcaactgaaaatggattaaggactttaacataagatgtgaaactagaagaaaacataggggaaaagcttcttgacattggtctgggcaatgattttttttttttttaatatatgatcccaaagctcaagaaaaaaaaataggtgaatggggccaggcacggtggctcatgcctgtaatcccagcactttgggagaccaaggcgggcagatcacttgaggtcaggagttcaagaccagcctggccaacatggtgaaacctcgtctctactaaaaatacaaaaactagccaggcatggtggtgggcacctgcaatcccagctccttgggagcctgaggcagaagaatcacttgaacctgggaggcagaggtggcagtgagccaagatcgtaccactgcactcctgcctgggcaacagagtgagcttcgtctcaaataaataaataaataaataaataaaacaaaaatacaaaaattagccaggcatggtagtgcatgactgtaatcccagctattcggtaggctgaggtgggaggatcaactgagcccaggaggcagaggttgcagtgagccaagatcaagctattgtattccagcctgggtgacagagtgagacactgtctcaaaaaaaaaaaaaaaaactcgag

SEQ ID NO: 2223 - DNA, 450 bp, Homo sapiens
ggcacgagacacaactgggatccaagtgtatgcccttggacacgttgcttaacctctctgtgcatcagttgggtgataatatctactcctggcacattttcagcgttggctgagttacatgtacagtgcttaggccacctgggggagagtaagagtgggatacgtgaggatgtggagtctgttgcatttctgtctgctgctggcatccttcttgtcttgttttgagttgctcgcctctgtctgctccctagggcgtagatttgaggaatattcctggttcttcccaggcagcaggggctcaggctgtgctggagtcagctaggctaaggggctggtctggcatccgcgttgtcctgtcacctccttggtgttttctccaggcctggatctgtgctgtgtgggcacctgtattcctccctcctgccctcactgattctccatacctttctt

SEQ ID NO: 2224 - DNA, 1375 bp, Homo sapiens
  misc_feature (825)..(825): n equals a,t,g, or c
  misc_feature (1346)..(1346): n equals a,t,g, or c
gaattcggcacgagcaaccattagacattgaagtgatgaatcgttatccgtgctgcacttagaccgaggctatccagtagtttatttatggtggcagtgtatctcaccaaaacactatgctttccagcttccctttcagcgacccatgttctttcattgcttctggtcagtgaaatctaagcaagtattttttgggtgagtcttccaggaaagtgtttaggggtgtggttaatttttgttctgccaggaaaatgagtgggatagctggaatcatgatagtcatggcatctctgttaatgtttttggtgcctttgaacagaataggaagaatcccccatctttgcagatgagttagaaaatttcctcctctgggtagaaggaatccctcagaatacacagcccccactcacttcttggtcaggtgtcttcacagtaaataaactacacaactgtatggggtggcctggacagccatattggactatgaagcaggaaaggaagccatgctctaaagatagcaaacccaaggagaaaagcagcctggtccttgctgaccatggatgtgccatatcagccctgcattgactacttccagacttcctttatgtgagagaaaaataacatttattttgttactgttatttctgatttattttactagcagctaattgcttgtwaagttaagactacatgatatgatttgagaattgctatcattaattaattaagcaattgttccttgtgaattctgtatcagaaattctatgatgtactagagataaagacagaatttgcaatctaggatgtgaaagacagatgtgtacncatacaggtaattatagcataatgtcatatgcttgttcagtttgcatgctggatagagacatctaggcaaaaggttagtggggactgtgctttgatagactgcatgcmcccagarggaaacatatcctaattcatctccacaaacggggtacctctttttaaaaatgcttcaaccaataataatgctttattatcatttagttcagtgattaccaaacttattttagcagccattagccttctttgaaagaataataatacagaaacacaacttattagttcagatgttttggagagatctaactcagattagatctaaaagagaatttgctggttaatttaaccacacttactgtaagagagttgggcacagcctgttaagggagtacatagcagggtttttagaaaaagcttcacagaggaagtgatgcttgaggtgaatcttgaaggatgattttaagaaaaggacaaaatgggaaacagcatactatgctgaggaaagcggcacgagcggmacgacngggggcccgtacccaatagccctttggtg

SEQ ID NO: 2225 - DNA, 328 bp, Homo sapiens
ggcacgagtaattttctcacttttgatagaggcatgggtacagagaagtatttttttttagtttaagtaaacaacagaacaagcattcatatgagacaactgacacaaacctgagggagacactagggagtggaggggactgtggtgcactagagaccgtgtatcccttcttaaggggaaccgtcccttctcagctcagctgactgttgccttggaggaaggcggagctggtatttctggatcttcctatttttcaaaggaagttaaacatctggtgttttatgtgaaatctttccattttctaatattacctgtttggtcgctgtgc

SEQ ID NO: 2226 - DNA, 649 bp, Homo sapiens
  misc_feature (567)..(567): n equals a,t,g, or c
  misc_feature (588)..(588): n equals a,t,g, or c
ggcacgagctgcccccaacaccagtctgatgggattgtcctgaggttggactccgttattggaattctaagccccttgggtggttttwatgtgtagccagggtcaagaaccctgcctgatagagtcatttggggcacacctcagcacagggcccagtacataggaagcccggggatgttagctggtgtgatggtggctgctggtgtcggctgatgtacagctttgtgtgagaggacagcttggggccggaatcctcccccatggctcctctttgccagggaccctgtgcgagccccatgctgacgtccctacccgaattctcctggaagttcctcctgtagcctcctgggtccccaggtggctccctctgacctcactgatgatgcaggtgcccaggtgtgccgtttctgacgcagggcagggccagggcttatgcagtcgggtaatgggctggaggcgggccttagggtggaagtcagtgtttctgtcccctgytgcagcaagagcaggataggacatcaggcccccccccccccaattccccagggaaagaaaacccaaccaatnccaaacccagctcccactttntcaaccacagttgcagagggccctgctgccttctgtgaaatgatggggctggacggctcag

SEQ ID NO: 2227 - DNA, 1521 bp, Homo sapiens
ggcacgagctccacttgaatttgcttagggacctcttcctccatttgactaaactcccagtgccgtgcaatggggtcacttcttgtctttccacggtcatcctatgcactccttcacctcatcggagtctgattccttatctcatgctcagccttgtggcgggcacgtgacaagcatcacctcctgaatttctcatggcaccggcgcaaggtacaggctcttgacaaccctgtgttatgtgtcaggaaactgaaattgaaatgaattatccatggctaaatgcattatccatggctaccagcagggaaatggaaaatatttgaaccccagaactgttgatcgagaattctttcaagttttatatttggcctcttctccttaatttagatattcagtcctatttccctgatgcctacaatgtgccaaagtcgcttatacttctttgcctttcgagttgctgttttcttgtctcaaaacatcctactcttgagttctttgtgcggttaatattttgtcatcctttagttctcagctgaagtgtcatattctcaggtaggaattttctacccacttttccataagcagaatatccttagtttctgtctgctttcacagagtgcttactgcctatttttaaatttactacactctataattatgttactgatctggttactgtcacctgatataattatttaatgtgcctggcttagtgtatgtagttgtgcagtaaatattcattgaatgaataaacgttaaaggttatgaaactgtgacgtaaaaatcttatgaataaaaaatggaagatgggaaaagtcagaaacagcttcattacatgtgtaaaacacaaaccaattatgtccaaagaaaagcaaatattatttccacagaattaataatttaatattatgtgaagtctgggtcattgaatacttgtaaattggcaattgattctcgatatattcctttaaagttataatcttcttgaagtttaagggaagaaaggtgctatgagagggcacaatggatgttgaataataaatttttaaaaacactttattcttagaagtttcactttggtttatcttccttagttaaatttcctttgtagcaaatgtgtgtacccttgatcacactgaagaaaatttggatgttgacagcacatggaagcattgttttcagatatcttcaacttagcaacttttggatgtcaggctccaaaaacatcacaggagggaaaataccctgactttattgtttgatgaaaatttgtggattgtgcaattattttgggtttgtatgatttgcttttatttactttatatattacatacagtataaaatgtacactttatctactttttataagtcacaattttatgggttttgctttacttatagcgttttcctcaagcaattcttcagatactgagcatcagaaaccaagtatttggaaactgagaaatgtgagctgaacagctgagtgaatcagacagggccctaatgaaaaaaaaaaaaaaa

SEQ ID NO: 2228 - DNA, 653 bp, Homo sapiens
gacaaaatgattatgcctttatgtgttgtgtgtatcgtactaaacccagtgctgtgcatagaggaaattttacagtctatagtgttacataagtactggggccttgcataaagtagatatctggtaattatttgttgactactccatgtctagtcaaatggcactttaattttatgttttggaacagttcagtattaaggattagtaataggaaaaagacttaacattttaattctgtgaatttaagtcattgtcttctgaagatggagtactttaaaagctccaaggagttatctggaaaaaaaatgtaagcagctttccatcaaaagacattatggttaaggtttgtactgtaggcctggtgtggtggctcacgcctgtaatcccagcacattgggagactgagtcgggtggatcacgaggtcaggagatcgagaccatcctggacaacatggtgaaaccccgtctctactaaaaataacagaaatttgttgaatgtggtggtgtgtgcctgtggtctcagctactcaggaggctgaggcaggagaattgcttgaatccaggaggtggaggctgcagtgagccaagatggcgctactgcactctagcctgggcgacagagtgagactctgtcccaaaaaaaaaaaaaaaaa

SEQ ID NO: 2229 - DNA, 687 bp, Homo sapiens
  misc_feature (664)..(664): n equals a,t,g, or c
ggcacgagagccgaggcctgaattgtgcaaagagtcaaacaggaatgcaatcattcaaaataaaacagtgtagaagtacatttgaatgaaacattatgggaataacaccgaaaaaatacaaatattttcttgagtctcatgtctttggctcgtgacctgcggcatcagctggccaaagaggtcaatcactggcatgtcaatcacgcaggcctctggccatggtaacagcagtctgtcagccagtcctcactgctcctgtctttgctctcctgctgccagctgtggcccgaagcccgtctgtcggagcagccttggagccagggaaaaggaaccgtagggtgaagagaggctgtggggtgccatttatgtagaaactgggcgcctgacttggctcttttcccaagctgtccacctaaaaaatgctatgtcgaatatcaccaatgatcagaaataacagggcagacttcgactctaaactaaagcttgcagaaagtttgatgtatgtgtgtgactatgctatggatataaagcctgttatcattttgaaaagggggaactttgtaaggtaagtaactttccaaataagtgattaaaatgttgataagcttttgacacatgtggaataattttttgatagatagttggcctgaatttcccttatttntcttgggaaaaacaaagcggatt

SEQ ID NO: 2230 - DNA, 548 bp, Homo sapiens
ggcacgagcggcacgagggcgtggtcctaagcagcacaggatccccctcggggacattcgcgggccatcctcctgctccggttctccctggggacgctccacgcctcaccgcagttgtagggcacagagacaggcctcaccaaagacgaggccagctggctggtcagcatgggaggagggcgcccaggcctgggcccggaggagcagccctcctcccacgctgtgggccctcgctgtggacccgggatcctgtccctggtgagctcatggactccacaagtgacactccatttcccagatggagcctgaggctaagaagcttggttcttgttctcatccagggcttgagcccagtgctgagccgagtctgaccctctgtccgtgggtgcaccggctgagtgcagctgtggccccaggctctgccgcagctccctggagagcaagccgcacccctggttgctgccccggctcccagcaaccctggagatctcttgttgtcacagccacttgggccttggacgacccacaaatgagagctaagcagttgc

SEQ ID NO: 2231 - DNA, 872 bp, Homo sapiens
  misc_feature (694)..(694): n equals a,t,g, or c
ggcacgaggggaaaaggtgagaggagaagcaaagaagtggaacaaagacttccaaattaaagagaccacttaagaaaaattacatcaatgtttatactacttataatgtacctcatttgggaaggaaaggctgttagctgctacttgttaccacctatcaaagcctctgtggcaacagtattgacatttaatccttggaagttctgaagtttttacaaacttggtggtgaggttgagttgatttgttttgcctcaataagaaatgttgatatatggtggctggtaagatggccgaatacgaacagctccggtctgcagctccgagcgggatcaacgcagaaggcgggtgatttctgcattgggtacccggctcatctcactggaactggttggacagtgagtgcagcccatgaagggtgagctgaagcaaggtggggtgttgcctcacccgggaagtgcaggggattggagaactccctctcctagccaagggaagccacgagagactgtgctgtgaggaatggtgctctccagcccagatactacgcttttcccaccatctttgcaacccacagaccaggagattgccttgggtgcctacaccaccagggccctgggattcaagcacaaaactgggtggccatttgggcagacaccaaactagctgcaggagtgtttcttcatactccagtgncacctggaactccaacaacacagaaccattcactcccctggaaagggggcagaagccagggagccaagtggtctagcccagcagatcccacccccacggagcccagcaagccaagatccactggcttgaaattgtcgctgccagcacagcagtctgaggtcaacctgggacactcgag

SEQ ID NO: 2232 - DNA, 1782 bp, Homo sapiens
ggcacgagcggcacgagcacatattgatcataggccatctgtaagcctcttcattatttgatcatcatgaatcgtcgagtctgtgttctcatgctgttggtggcctggattggaggctttcttcactcattggttcaatttctctttatttatcagctccctttctgtggacccaatgtcattgacaacttcctgtgtgatttgtatcccttattgaaacttgcttgcaccaatacctatgtcactgggctttctatgatagctaatggtggagcgatttgtactgtcaccttcttccctctcctgctttcctatggggtcatattaccctctcttaagactcagagtttggaagggaaatgcaaagctttctacacctgtgcatcccacatcactgtgatcactttattctttgtcccctgcatcttcctgtttgcaaggcccaactccacctttcccattgataaatccatgactgtggttttaacttgtataactccaatgctgaaaccactaatctatgccctgaggaatgcagaaatgaaaagtgccatgaggaaactttggagtgaaaaagtaagcttagctggaaaagggctgtatccctcatgagaatatgactttcattctttcacagaagcaaggaataatttcactatcctatcagattacatttctgttatcattcgcctttagttatttagcttacttattctgaagcaattatatacattaatatttatgtaagtacaatatgttaagcccattacagaccaagataattgcataggtttaacagtgtatagtgtttttttaatcatactgtgttaagattctttagtagtaacgatatttagttttatttcaagctgtttttaattttaaaaatcatttatttttcttttgtatttagtttaaattgacaataatttagtatatttatggagtacaatgtgatgttcctcgtgccgaattcggcacgagctcagagccattgggtagcttgcaaaggcttgcaggtgccattaaaaggcagagccaggacgtaaactcagagtggagaggcttatctctctccactccctgatcgtctcatccccgaaccctagactagagggagctttataggctgatgcagaagttcccaaacttgtcggcacactgggagcaccaagggagctcccaagagcactcatgcctgtatccaaccctagagatggtgaattaatgggtacagggtatgaccttagctttggaaattttcagattcccaggtgatcctaatttgagacaagcttgggaaatactggtaaagtcataaagaacaagttctccgaagcccacagacctaagttcaaatcccagattctacacttcctagctgtgtgaccttgggcaaaatgcttgatcactctctgccttggtttctccatagcatctactccacagggatgttgtgaagattaaagaataaattataaagcacttagaagtgtttgccattattggtttcttaaaacagcaataaaccaactaacaaaacagggacccctggcttctgtgcctgggtgtccaggaggaagaacatgctgaaaaataccaccaatatagagagaccaccaatcagaacttgggctgggaggagttaacggaatcttcagccatcagagctggaaaggggccttagacagcatctctttcctcaccaggtgcaggttgtatgggtaataactccaaagaagctaaatgacttgtccaaagccacacagcaataatacactg

SEQ ID NO: 2233 - DNA, 702 bp, Homo sapiens
ggcacagtcacaccgctaaattatgaaagaaataattatcaacactttctaattacctaacaaagtaatttgggattcaccgtggggctggcgggatggggaaccaacatccacttacagccagggtggtgtacgccacaccgcgagggactggctgtattggtagtagtggcgatggggtgggggctcttgtgcacttttttgtacctagcaccccagaagacagaaggagcagcggcagatcttgcctccactagccctgccccctaggcctggtggcgcgcgctttggccactggaggtgaggaagatcctgggtggcaacgagagacgtctacacatagataagggagcctaccacaggcctgggtttgctgcgggtttcggtgtcccccagggactcctaaactctggaagtcgcgctagacctcaggaggccggaaaatgaccacctggcgtcggtggctccagcagatctgagcccctaggccccctgggctccacgctgagccgcgctctcggggcgagtgagcccggggctctccgcgcatggggagtggagaagggagggggaggaggaggaaggctgggagggaaagaggatgtgtgtgttgggggagggaaggtgcagccgtctttcctgggaggagaagcgcgggttcctggctctccacgcgcactgctttaatcagacccgtgcagc

SEQ ID NO: 2234 - DNA, 917 bp, Homo sapiens
  misc_feature (610)..(610): n equals a,t,g, or c
gtctatacagagattatattttgtagaaggataatccatgtctcactgccctctcaaatcaactcctcaagctcttatgcaacacatacacacacacacatttaccaggtgtgactaaagtagataggttgatcatttacatgtaaaaataaacatttagtcacctcccacactaacaggcccatgctgaacctttgtatcactttgctctttttatcagtgaccttgaccaatatccactcaaaccactcctcctactccaactacttgctgtgatgggagcaacacacacacacacacacacacacacacatacacacgcacataccacatacccacccatacacccacagtcccttggcagtaaagtaactaggatgacccagaagacccatccccccactgagaagtgtagaagccatgagtttcaccttttttgaaacatctgctgatttacatttgctaagatagttatgtattagctagccacctaacagtgaaaataatgacatagaaggaaaggggagaataaggcaactttattccttttccatccagtccttccttcttcgcctgttggtagaatgtgtttgtgtcaataagtgaaatnaaaacagttgagtacaagccaggtgcggtgctcacgcctgttaatcccagcactttggaaggccgaggcaggtggatcacttgaggtcaggtgttcgaggccagcctggccaacatggtgaaaccctcatctctactaaaaataccaaaattagctgagtgtggtgcatgcacctgtagtcccagatattaagaggtgaggcaggagaaccgcttgaacccaggaggcagaggttaccgtgagccgagattgtgccactgcatcttgcctgggcaatggagcaagactccatctcaaaaaaaaaaaa

SEQ ID NO: 2235 - DNA, 1260 bp, Homo sapiens
ggcacgagggagggcattctcagcacctctgtgaaatgcccctgaaaatgcatccagaagatgcatcccctactgttttatttggtgaagttattccttgaggccagagataccacctgcattattatgtcctgcccgacgcctggcatccaggaggctctcaaaatcacttgcagttgacataggtgaatatcagcatgtgcgccttgtgttaaatgcgctggacacaagaaccagacagagcagttctatcttaagggatattcaagaggtgcctcttacctgtggggtcagaggacaggtcttaggattgtgaggtcaacccttgtctaaggtttcactgggaaattagggtcgggtggacttctcctgggccctcagtcctcagggtcaatctcatgagcatcagctcttctgcctcctccctcttgaaagtgagagatgagatggtaggggaggcatccatgagcacttggaggagaaacaggtactggggctcctgctcacagcatcataggaattcctctgtatggcccaggtgcttgggatgtcaattctgacctaagagagtgttccaaacctttgtgtctcaaatgtggtccaaggacccatagcatctgcatcacgtgggagctcactagaaattcagaatctcaggtctcatgccaaacccagtgaatcagagtctgtatcttaagatccccaggggatttgagtgcaccctaaagttgagaagcactgctcgaaattgggtcctagtagatatttctcctccatcctaccctccatatgtggtcttgccttatgccctcaagggccctggcacctgttgccctccgacaagcctggggggccgccttgaaggtacatatctcattgagacaggagtgtgcctcacagaggctccctagtagtcctcaaccccttccatgcctctcctgttagggatccgctgtgggctgggcactgtgcaggcccttgcagtgagatgactcagctccaggtcctgcctgcagggcccaaccccggcttggggtctactggaagagacaggccacctacctccctgaccactgggtgatataaaatgtgattagacaagaaccaagaggccagaagttctgggaggcacaatgccttttagctggagcagtcaggagagcgtcacaggaggtagcatctgtgccaggccctgaagcccaggtaagactggttacatgtatgtggggaaggacaaggcaaagcggcaggaaattacat

SEQ ID NO: 2236 - DNA, 859 bp, Homo sapiens
gattgattagtttaactggccaatacttgttgagtggcttacaagactatagtagttaaaagcatgagttttgttttatcacttaaatcctggcaaggacttattaaccattcgactctgggcagggttacttaatatctctgcctcacaacattttccgtatctctaaaatggggttgttcaacaagaaatatactcaagtttaacatggcaacaatgttcaccaaaatcactaccagtatcgtctttggtctgtctctggcattgcctatttcaacacgggcatgatcaatgtgcatgatcaatgacaatgtgatagcaagggtctccatcatatcaagacattgttacaatgtcagtaatacaaagcagtttggaatttattgttaataacataatattcacttccaaaaacaggtaagcaatttagatctaatctagggtgaaaaaacctacttatgggctttatacattgaagatgcatcccttagttgaatattatgacagaaaaatgttatcaatgctgacattaaaaactgttattatgtgccaattattaggaaattttaaataatttaacaggataagattaatagttaaaccgaacactaagaaagagagtattagctacttgacgaagaacattgtatattttttgagactatgaatttttataaaatgtcaaataatacaaagcaaaatactactaaaatgagatattataattctcatctttatggaactgcttagtttcatactcataacatatataaaataataattaagaattacagaggccaagcatggtggctcatgcctttaatcccaagcactctgagaggctgaggagggcagattg

SEQ ID NO: 2237 - DNA, 1516 bp, Homo sapiens
  misc_feature (1025)..(1025): n equals a,t,g, or c
  misc_feature (1144)..(1144): n equals a,t,g, or c
gaattcggcacgagaaagaatgaactgtttatgaaagaaaccttttgaaagacagaatatttttgcctgtgggccaaagctgaggcaggaaaacaaagggctctttcaaaggcttagaatatgatggaggatggattctgactttccaactacaaaaataatgatgcttttagcatcaatacctgcattactccagggagttgtaaatatactttacagacacaggctgggcctttccaactttttacctcagtgctctttgaactccttaaaggggagtaatgttggccccaatttgcacactgagaaactgaggcagaagaaatctaagcaatttgtcccatgccaccagataacttataagtgaagtcaagaatagaacaaactgaaactgaatgcttccatgacacaggagcatctgccatctggaatagttccttctttttctctagttgatctctttcttttctgcttttatctttcattttctgattcattaactcttagctcttgtcaatgaattgaggccagtgtgagtgttgacatgtccatcagaaagtctgtgttggtccaggtgacaaagaatctacagcttgtatcagccagcctgtgcaggttgttgcagttcctttgaacaatattactagcaaaactcatcttgaaaacaatattctttcatcctaacctattttgtwcttgcagaaacactactgtaaagtacagatgctccttgacttacaatacagttatatcctgacgaaccatcataagttgaaaatatcctagttagaaatatattttatgaacctaacctattgaacatcataacttagcctcacctaccttgaatgtgctgagaacatctatattagcctataattgaraaaattaactaacacaaagcctawtttattatatggtgttgaatatttcatgtaatttattgaatactgtatagaaagtgaaaaacaaaatagttgcatgggtactcaaagtatggttgctactgaatgcgtattgctttngcatcgtcatgaagttgagaaagtctacgttggaatctacagcttgtgtaaaccagcttgtgcagcttgttgctgttcctttgaacaatargatattrgcaraacttatcttgaaaacnagataaaccatcacaaattgggtattgtgtgtatgaaattttacatttgtacatttaaaaaatatccggtgtttggctttttaaaaaaataaatggtacctaaatagttcttaatttccccttatgggtagtctcctagctgttaaatgtacatttatttactcattcatttttttatttgacagctatttgttttgaatttacttttggcacagcactgggctttgtaatgaatactgtacaacagatcaaaatcttatagaagattttaataaagattttataaagattttaataaagattaagtctttaagatttaaaaaaattttaatttctttttttttttttttttttttttttagctagtctcga

SEQ ID NO: 2238 - DNA, 508 bp, Homo sapiens
  misc_feature (255)..(255): n equals a,t,g, or c
  misc_feature (473)..(473): n equals a,t,g, or c
  misc_feature (502)..(502): n equals a,t,g, or c
agctggcatgaaatatgttttctccagtttgctacatagtcctctcttctgatgtttatcttttttttttgactaatatttgtattggtaagaggtgctttggaatttgcacacatgargaaataaagagcttttttcctctacatttctaatattcagctgctctcttacctttcttgtccaggtattttgacttttaaattctctaggtggtttctctttctctttctctttctttcttcctttctttctttnctttctttctctttctttcttctttcttttctttctttcctttctttccctctctctctctttctttctttccttccttccttctctctttctttctttcttgaccaagtctcactcttttgcccaggctgaagtgcagtagtgtgatctcagctcactgcaacctccatctcctgggttcaagcgattctcctgcctcaggctctcgaggggggggnccggtacccaattcgcccttaataatgantcggaa

SEQ ID NO: 2239 - DNA, 311 bp, Homo sapiens
ggcacgagggctcccacagccctcctgatgaagtcattgctgctcgccatagccttccagaaacttcttggctccccccaccccattctccaacctcacctctttgcatccctccatccctcgcccctcatagtccagggatcctgaacacctgtgcttccccaaacctctcccgcttccaggcctctgcacacgcagctccctctgcttctccagcccttcagaaatgggccagtgacagagctctgtgcttcccacaccgtcgcctcttccggggttcagaggattcaaggccccacttcccagtctcc

SEQ ID NO: 2240 - DNA, 1338 bp, Homo sapiens
gattcggcacgagctgggttccaggttcccagggctggctgtgagctactcaagggcagggctgtatctcgtttcctgccatgcctttgtgcctagcacagtgccaagcacacggcaggtatctgaacagtgtgggaagagaaaaggtggaggggagatggttgggggtagactgtgagagtggaggtggctcaacgctcccacccccaacctcacacacagcacccttagcccaggcactgatcccaggagtctaagaagctgattagaactgcccatggctgcagctaacctcggaactatgccccaccacctgctgtcrtctccctgcccccactcctacttccctctctcctccctccccaggggtccggggcagcctccccctcccccaccccatggtgagaaatcccaaagactcctgggcctttctctgctgcccggctttcccgcctcccctttttctttctcttccttctgctttgcctcacattcaatctctccctcccccagcctggtgaatccaaactgaaaaaaaaaaaaaaaaaaaaaggcccacacaacagcttcaacagtgaaaaataaccaatttaaggagtaatcgctgctgtaatgattgtctaagccctgagtcactgcagaaaatcggactgaagctctgggactcccaggctccctgagagtgtcatatgggtttttgtttttgtttttttaaatatccaggacctcagtgtctccatctgtaaaatggaaggaatattatcagcccaaaggaactgattgttaatctcctgattttccctggggctgggaatcagaggttaaggtggtccacacagttggcttgggaatcaccacgggacacattcttctaccacaggacccatgggagaaatgtggtgcctggcaggtgctgagagactcacagcttcgagggtctctgggaaaggtttctagagattgtggtgtttaactgagctgggaaggatgaatgggtgaatgagagctatgggaagtgatggagtgatggaaagtcagctctggaagagactagacacctcatcttgccctatgctctcattttacagatgaagaaactgaggcctgaagggcttcaggaactgctcaaagtcattagtggcagagcccaaattagtggcagagcccacattagaaaacaggtgccttgactcctgctccagtgctctttctttctttctttctttttttagacggaatcttgctctgctgcccaggctggagtgcagtggcatgatctcagctcactgcagtctctgcctcmtgggttcaagtgattctcctgcctcagcctctcga

SEQ ID NO: 2241 - DNA, 1736 bp, Homo sapiens
  misc_feature (369)..(369): n equals a,t,g, or c
  misc_feature (605)..(605): n equals a,t,g, or c
gaattcggcacgaggaggccccacaatgtcccccaactgccacttgctggagaccagaccctcagcctccctgcttctgctgggcatccctctgctcaggggagcatcttgaggctatacaggtctcaggtgcagctggcagcaaagagacataggaggaggtggttgaacccaccctgcaatgtccaaggtccaggttaaaccctgagagtgggtgagtgtgtctggtcctgtgactcagtttccctacctgtaaaacagagcttcaacgagatgaacgatagtcctgagcataacagtccacaggggcccacgagccgcttctgcgtcccaagccctcgtttctgcatccwgtctycatctgctcanctctgaatgaacccatggtcccctggaggactakgtgaagaaataccctaaacacctccccaggcatcgagctcatgcctccagcacaaggcctggggctgtaacgcagggagctgggctccagcttgaatgctgctcttyctttctttctttttttttaaaaggggtgaaatccacataacacaaagtgaaccactttaaagtgaacactttcatggcgtgtggtacattcacanattcatggatgctcgtctcctatacctgagctatatcctgcctgtcacaattccataggaagtaaaaccagccactttctgtaaatgggatcttaagcagaactctaacactgtgcacaraaagtgtgactgtgctgggttcgaggaaracagggtctggtctgtgtccccagccgaatctcatgacaaattgtaattcccarcgtgaagggarggamctggtgggaartgatgggatcatggggaargattttcccctcgctgttctcatgatagggagtgcgttctcgtgagatctggtggtttaaaattgtgtagtgcttcccctcctttctctgtctctctcccgctcgaccgtgtgagggccttgcccactcccccttcacctgcgtcatgattgtaagtttcctgaggcctccccagccacgcytcctgcaaagcctgtgaactttgagccaattaaacctcttttctttataaactacgcagtctcaactaaagaaaggcagttctttatagcaatgtgagaarggactaatacggagaagggccacctgtcctttcaaaggccccgcccaggaccctttgaaaccagagcgtccaggtgccctctcggatgttttctcatctcgggagtcctgtggttttaacgttcttttacgatcacacctctagagagtgctgattccctggataccacaggacctccctgaggtgtccaggacagagcaagcttagatattaggcagaggttctaggagctgtgcacccctgcacccctggaccagagagtctgggtgaggaagtgggggcgggatgtggggcctgatctctgggctgctgaccacagaaagggctcacaccgggaagtggacttgggcctgtccagggcagttccggggcagaaatgggagctggagatgtttgtggctgttcccgtgaggatgctccagccccaggaggccgtcggggagaggccggtgctgtgtggaaccacacatgtgtgagccagtcaggagactgctgtgtcagtcaggaaaggccaacacagtgcactgtcctcacactgggaggaccggcttcccaccccactccagggctttgtggtaagcctgacgcaccccactcgta

SEQ ID NO: 2242 - DNA, 522 bp, Homo sapiens
  misc_feature (436)..(436): n equals a,t,g, or c
tgtaattggaaatatcaactcatgttgaatgtgtttgctgtacctgtttatgttttattgattattttctgggagaggagggctaaaaaatacactgcagagaatagacaatttatgctataaatataattgcaaatgccatgaattaaaactgctgctggatagttcaaaacaatggtgttttgagaacctgaccaaaggcagtctttccaagaatcagtcccgtattcatcaagtgcactcatagagaggcagggctccgttcttaattcctccctaaatatctgattcagacagagaaaatgtgtctcatcttccttccccattctcagttcctatcccttgtcaacgcaaacacaatttatgcaaatattctttctttgtttctttcttctttctttctttccttctttttttttttttgatggagtctcantctgtcgcccaggctggagtgcagtggcgcagtctcggctcactgcaacctccacctcctgggttcaacctctcctgcctcagcct

SEQ ID NO: 2243 - DNA, 591 bp, Homo sapiens
ggcacgagaaagaactattattactcccgttttacagatgaagagacagaggcacagagaggtcaagcaagcggcccaaggtcacagggctaagacagaacagagccaaggtctgaggccaggcaaccggactccagcattctaaacctccatgcagtcctgcctctctctcttcagctcatacccaggtaagcaggccaagctcaaaaatagcagccaacgccattttcaaactcatgctttatgaatcttaaaatacttacttgtttcctagtttcttacacctttccatcatctcggtcagcagagcctattatgttaaaaataataataattaaaaaatcaggttggaggagctaaagtaacatttctaagagatttccaaagtcgaactctaaaatgaatgtagccacatgtccattaagataattctcagtgtctggtagggatggggaggcttggggagaaaaaaattcactttcattgcatttagtgtaataaatagaaggagggggctgggtacagtggctcgcacctataattctagcattttggtagaccgaggcaggtggatcacttgaggtcaagagc

SEQ ID NO: 2244 - DNA, 610 bp, Homo sapiens
ggcacgagggaggaaagagggtggaatctggacagtatgaaggatttgtattgtacctgtaatgtttgatgtctgaagctgggtggtgggcatggctgtttgttattctccatccttttggtatgcctgatacatttcataataattttaaaaaggacaagactactgcagagaaatgcatagagtgagctctgtttgggtttttaaaatgattcctacatctatgcttgcagatgtaagcaccagccctggaaaacattgcaagggattcttagtaggcccaagctttgggaaagggccaagggggctggggagttgattaggaggggatacatgctttttcctgctgccttttgaattttgtaccacacgtagtattacttattaattaaaaaataatctgaactagccaggcgtggtggcacatacctagtctcagttacttggaaggctgaggcaggaggatcacttgagcccaggtggttgcggccagcctgggcaacatagtgagaccctgtctctttagaaaaaacaggccaggcatggtggctcacacctgtaatcccagcactttgggaggctgaggtgggtggatcacctgaggtcggga

SEQ ID NO: 2245 - DNA, 695 bp, Homo sapiens
  misc_feature (2)..(2): n equals a,t,g, or c
  misc_feature (25)..(25): n equals a,t,g, or c
tngccgcccgctctagaactagtgnacccccgggctgcaggaattcggcacgagcccacctcagcctccctagtagttgggattacaggtgctcaccaccacactcatctaatttttgtatttttagttggccatgttggccaggcttctcttgaactcctgaccctcaaatgttctgcccaccttggcctctcaaagtgctgggattacaggtgtgagccaccgcaccaggcctaaaattaaatggattccggttgcaggtctttggctcaggctgttttccctgatgtttctgcaggtcagttacttatggactgatgtttctgcaggtcagttacttatgtggttgtgcagatggccaaccacagtggccggttacttttctcagggcacctgccttctagaaatgtatcctctctcctctcccttttcctctttctgtcagagaatagcaggggttgtggaggaaagctgaattctaaattagtcatttcgataattaataaggctagctagaggtttgatgagaaaaaaattgctgcttttttttgtaagtgtaatgtggttagatataaagtatccaaaatttagacagatctcaaaatccaaaattttatttttccctcaaagccatgcttaagtttactcagaataaccacagcatttttctgaggctctgcaaataccttctcgag

SEQ ID NO: 2246 - DNA, 568 bp, Homo sapiens
gcacatagtgattttctcctgtgctttgtctccagggacattggctgctgtcttctgacccaccctgtgtggctttggcgtctcctgtgacctaccagtatgggtcttggcctcatcctgcctctttgtctttctggcccaccacccacagcttgaatctcaggctccaacagttgcctgacccccagattctgatgacagcctacctacttgttcttcaggccctcaccagactcactgcccagacacaccacacaggagaacatgaaagggtgaatgaatctttcatcatttgatgaccaagttggcattcttttacattccagccaccagaggaaggtgtattttaacacaattgccctcacatcctccttaacaggatttacataagtttattaacacatatgtttctacaaaatcaagttttgagaaccatttttatacactgatctgggacattttggggatatgaaattaactttagcacacacagcaagaagaaaaccgaacaacaaattctacaaacaccaaatttgctgtgaaatttacatttcagattctcaagaaa

SEQ ID NO: 2247 - DNA, 468 bp, Homo sapiens
ggcacgagaggccctggggtggcggggagaggaacagggagagcatgagacagacccacagggctgaggccaaccctgcttttatttcacaagagcttctcgatggctgacaggagctcgggtttcaggatggagtccggctcggcccccgcggccttgatgtcctccagcacagccatgtcccacgagaaggtcaggagggcagagggcacctgcggtaggggtaggccgtcactctgagaccgagagtcggcccttgccgcggcagggaactcagcgggcaacctgggcgcggggatgccccggcctggaagccatctcagctggtggaggctgtggctcgcacccaggcctcctgccctgctcctccgggactccaggacctaagcctaaacctactgcactagtaacgcacgtcaccgctcccatttgatggggaaactgaggcgtggagtagttatgaacttg

SEQ ID NO: 2248 - DNA, 1138 bp, Homo sapiens
ggcacgagcgagtattgagttcattaatggttattatcatcgtgtttaatcagtaagtgattttaactttcttcattatcccctcctcttgtgtaactgtggataagtagttcccatggattgcttcctctgtcttcttagcgagaaatatcggtggctatgagatcatagctcaacagcttcaattctgtgctcttcctctgagcaatttttcttcttttcagactttttccttttcttttcccttccctttttttcatgttcttcctctgcaataagaaagaatttagaaaaaggaatgtaaatacaccatttggaaaaagtagaaattaacttcggttataagaagacttgggtgctcactaatgtaacttttcctgttggctaggaaagggattacacctagcgaaaggagacagagcaaggatgagaggacatttgcccactgagaagagactagtgaacactcgtttcttcctaggtaatgttttggttcagtatcgcaaaggctaatgacatcttttgtaaggtgtgaactgcctctgaactaagaggcattaagatgatgagcagaaagagcactaagattgatgttaaaattaatggcacgtgagaaacatgtcacatataaagacagagaaagctgtagagggctgggtgctcaagacaacttgtgatagattttgggaggccactgtccacagactgggatccataagccttaggggcattgtcacttggtctggtaacccatctcagtctgttctggggtccctggacctactgtgtgagatatcaacataccatttcttaggcactagttaatatttcctgaaataaatatgttaaacagtccaggtgcaatggatcatgcctgtaattccagcactttgggaggctgaggtgggcagattacttgaacccaggagttcaaaaccagcccggccaacagggcgaaatcccatctctactaaaaattaaaaaattagtcaggcatggtggcgcgtctgtaataccagctactcagggggctgaggcaggataattgcttgaaactgggaggtggagattgcagagagctgagatagcaccactgtactccagcctcgacaaagagagactttgtcaaaaaaaaaaa

SEQ ID NO: 2249 - DNA, 898 bp, Homo sapiens
ggcacgagttgccctttagacttcctggcctgatggactgttccaagatgcagtcattctcctatggtctttctggagatgtcttctctagactgagcagccaatgtgttgctatgaagctctggctagctgggtaatgcacttccttgtatttgctcttcctcgttccttgtctcatgtctccttttccctgggattctaccctacactgaagtaatagcacacaaatttttgtctcaagttctgttgtctagggaagccaggctaagacatggttcaatgggtgtccttagaaagcagacctccaaaagagaactttgggtctccaccgatggtggcaaactgggtggcccggattcctggcatgcagtgatagtacaattgccaatatgttatgtggtataggcagaaggcaaggtattggcatatcaagtggctgtgtacttgatcagtacagagggaacgataatcataaggattgtgttacatggtggctgcctttgatggcttggaagatttgcaaaaaggcataacagactcaggaaagctaattgcccacttaaaatatgctgtgaaagtcagagggcctctatggtagccttccaaatcctcttatctactgcagctgcagggcaaatgatggaggaagaaaatcatgttcagggtttcatggtatagggttgcaaacctacaaaggagaaaaaattcacagccttaaaatgtctcctgtgtcaatgtgaaggctttgatagggaaagagtaggaacctgaaacctgcaaggtggacatttgagtggacaaatctaataatctgaatgtccaaatttccctgcctctctggagattatgcagtctcctcagttggagactatgcagtatatcactcgatgtactataa

SEQ ID NO: 2250 - DNA, 764 bp, Homo sapiens
ggcacgaggtcctaaggtgagaaggagggccactagcataaaaacaacttgaacagaacttgcttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcatatttgccatattctaattattagatacaaatcaataggctcgag

SEQ ID NO: 2251 - DNA, 417 bp, Homo sapiens
  misc_feature (386)..(386): n equals a,t,g, or c
ggcacgagggaaacttacccaggtttctataaactagactgcaatctgcaccagtatctaccagcgctaggacctgctgtacattagtggggaaccagtggattgccaactccgcatgtggcctccctccactcccacctccttcaccccctgctgccccaagttgggcacctcggccatttccctaatcaaacaagaaaggctccatatctccacccaactgcaaatagtccttgagctccagcgcctgggcaggattagattgaacaacactgttttgccccctcttggtcattttccagaatttttgctctggggacaattgactccacagagccaagggcattccattgggttgcctgtyaatttctctcgagggggggccngtaaccaattggcctatagtgaatcgtatta

SEQ ID NO: 2252 - DNA, 817 bp, Homo sapiens
  misc_feature (4)..(4): n equals a,t,g, or c
  misc_feature (7)..(7): n equals a,t,g, or c
  misc_feature (600)..(600): n equals a,t,g, or c
  misc_feature (683)..(683): n equals a,t,g, or c
  misc_feature (685)..(685): n equals a,t,g, or c
  misc_feature (728)..(728): n equals a,t,g, or c
  misc_feature (811)..(811): n equals a,t,g, or c
  misc_feature (814)..(814): n equals a,t,g, or c
atantgnatcactcattggaacattagctggagctccaccgcggtggcggccgctctagaactagtggatcccccgggctgcaggaattcggcacgagctcgtgccgaattcggcacgagaaattcatgggagtgggattattaaatagaataatatgaacaattgtatggcttatgtttgccttattgtattcccaaagagctgtaacattttatagcatcaccacttgggcaggggtattacctgttgttgctaatttagtaagtagaagagagagatcaaagtttctctaatttgtgtttgtgtaatttatctgtatactttcttcatttatataaataaatgtcttcactttgggaggctgaggcgggcagatcacctgaggtcaggagttcgagacaagcctggccaacatggtaaaaccccgtccctactaaaaatacaaaaattagttggatgtggtggctcacatctgtagtcccagctactagggaggctgaggcactagaatcacttgaacccgggaggcggaggttgcggtgagctgagttcacagcctgggcgacaagagttaaactccatctcaaaaaaaaaaaaanaaaaaaactcgagggggggcccggtacccaattcgccctatagtgagtcgtattacaattcactggccgcgttttacaacgtngngactgggaaaaccctggcgtacccaacttaatcgccttgcagnacatcccctttcgccagctggcgtaatagcgaaaaggcccggaccgatcggcctttccaacagtgccaacctgaatggcgaanggnaaa

SEQ ID NO: 2253 - DNA, 1653 bp, Homo sapiens
  misc_feature (1111)..(1111): n equals a,t,g, or c
  misc_feature (1613)..(1613): n equals a,t,g, or c
  misc_feature (1625)..(1625): n equals a,t,g, or c
  misc_feature (1631)..(1631): n equals a,t,g, or c
  misc_feature (1637)..(1637): n equals a,t,g, or c
  misc_feature (1651)..(1651): n equals a,t,g, or c
gcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctyctgcagagagagaaagcccatcaaagttgacttcagtgactcccccttcactcacccctcatcttycacgggcaaccaactycctttttgattgacacatcatttctttacatacattaatgccttccatattaccacagagagtttggtagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaattnattcttacttacattargatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagattttggaagataacactgtttgctgattttacaagcccgctcgggggggggnccggaacccggngcggtncccgtncctttccccccccncg

SEQ ID NO: 2254 - DNA, 713 bp, Homo sapiens
tgcaggaattcggcacgaggagactcttaacccccgcaaaattatccaggttaaaaacatacgtgagcttcagaaagggtgaacatagccatggctgagaatcgttgtggattatcatgataggaaattgacatgcttatgggtgttctgtcctttggggttgatgtcagggagccaagtggttgcactatttctgctgtgtgtccgaatttctaaagtaatatccgtgtattgtttggagagcggacttttttgctttactcctacttttacagaaaagaattttttttctcaagcaacaaaacatttggtctctggtgtcaaagaggactttattatattagaattataaagctttagttaggaataagtgttggacattattaaatcaatttactgcaggctgggcatggtggctcacgcctgtaatcccagccctttgggaggccaagactagtagtctccaattccattccatcacttgaggccatgagttcaagaccagtctggccattgtggtgaaactccgtctctactaaagacataaaaattagcatggtggcctgcacctataatcccagctactccggaggctgaggcaggagaatcacttgaatccatgaggcagaggctgcaatgagccaagatcctgccactgcactctagcctaggcgacagcgccagactttgtctcaaaaaaaaaaaaaaaaaac

SEQ ID NO: 2255 - DNA, 318 bp, Homo sapiens
ggcacgaggtgccccacccttcactctctccccgcataactctcttccgcatgtatatgtgtatccatgtctgtctgtctgcttcttaccatctctcctgaatctgcctatgactttctttctacccattcctacaaatgcttgcagtcttctgttttctaagtcccaacagcttattgtttttcattttctggagcagggtctacaggtttccaccaaacagaagatctcgccctgggatctttttgaggggttgaagccgtcagcaccactctcttggggctggtttggaacagtccgagtggaccggcgagtggc

SEQ ID NO: 2256 - DNA, 1860 bp, Homo sapiens
gtaaatactgaaatgtcaaagtgaaatctcctaactacatctcactatagccacagatttccaacattacttcatttttgttatactttggatgactttttacccagactcctttgtcccattttttaaaaggacagacacggtacattgagcttaattttaatgttctctctaaaatgctaataattatggctcaattattacagtggttttcttgttggagttttctccctttagctgctctaaattgtgagtggtatagagtcacagagcttacttgattattcacccagtccactgctgatgctacgtgtttcttcaggacctgtcctttagaatacttcccagaggcaagcacatggttgcctatattaaagccacctgtatatcacttgctaagtcctctttgtcaacacttgccctcattgtgactacagaatcactttttctagtttttaaaattgttatcgtaagactgtgcttggaaatattcccagggattagtatgatgattttgttggggtgtttggagatacatttgccaatgctgtacatgtaaaatttccatgacaacttataaaataaatactttgatctctttatcagccatcaatgttaacatataaaatcagctgaattaaagttaagactatgtaaacagatgactagaaccycttcttaagtaaaaatatgtggtggtycccttaattacktgycattggaaatttgtaatycctttcaattttctgaacatatgcacaattttactattctaaaaaaataactattcataactactcacttattttctcctttcacgcacttctaatttttggaagaagtgatgggcatttgttccctataactcttgccatctatatccacctggatccgtagcaatttgggtcttatctgaactactacgatgaactgcactcaaaattacatttgatgtgatacacacagtaactcaattctttctttgctttcatcttttgcaatcatctacctccctatgcagtctggacaaatactgtcaaattcctaacagcatcatcattagcactgttgaaatccttccatcatttagtagatgctaagcctgtgttgtccttcattgscctgagatgctatgcagtttatctgcttgcacacttcagatgcaaaacatagatgggaaaagtaaggaagcatactgatttgcattcctacatatttgtatgctttactgtttctcctgatgcttctgcttccaattgccatcttcaccttcgtcatctctagcttcctactttactctcctcagtcactgttcattcttagcctctgatttctatcacttcttttgctgtccaatttgtgcttmatmwatttctttcctcaaatacctctccagcatcattatgtcrcaaaattatttgccctgagaatctcttgctcttcccctgctttgtgctgcagggagactgattcttatctcactgtgtcagctgcattccagccagagtccacctatgagtggctctggtaagagattggaaggccgaagattctggtagttttcttgtcagtggctgtctcttctcctacctactgctcctacaagaaaggcctgcaaaggtttacactcctgctatgtgacatctgagcttctggtaaatctcattctccccttgtccctctgtctgggagtggaatgtttcctgacatcgctagtctgtgtgtggcttcactgttgatttgactgctttcacttttctgtcatcagtataaccaaaaccctgcagaaaactgcctctgttgtaaatacttaaggtggtttttgttcctggttggatcctaaagaacacaaaatcattc

SEQ ID NO: 2257 - DNA, 1120 bp, Homo sapiens
gggctgcaggaattcggcacgaggcagcagagagagcctgggttggagccatgaggctgcccctgcgtcactctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagagggacattaggtgagccacagggtggagcaggatgggagggcagaggcttctgcttcagaattgaagccgaaggaaagtaatgctgtgggtgttactggagacaaaaggaaccaaacaagaaaaatctggagaggcaaatgttgatgtcttaatagatttgggagtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctc

SEQ ID NO: 2258 - DNA, 1068 bp, Homo sapiens
  misc_feature (1060)..(1060): n equals a,t,g, or c
gctttgaccggacagacagatacttagatagctggcaaaacattatttctaggtatgtttgtgaatatttttccagaaaagtttaatatttaaatcagtaaactcagtagacaaaacctaccctggacaacgcgagtgagcctcgtccaatcccttgaggccccagaagaataaaaaaagaggaagggtgcatttactctctcttcagttggaacatctatgctctcctgcctcagacattggacatggaatctcctggttctcaggcctttggcctccatggttacaccagcaccccacctggttcgcaggccatcagtctcagactaaattacagcactgggtttcctatttctccactgctgacggcatgccttggggctttgggcttctataattatatgagccagttcccataaacaatcacttctcatatatctatatatacctattggttctgtttttctgaagaccctaatacagccccatagcactatatttttattttttctaaaacatttaaacagcctatttttttagagtcatttatgtaggtatccaattctctcatgaacgcctcaaggccagaaattcaatccattttawttttgccattgccgcagaggaggcacactgtagctagtcaataagtggttgtggaaggaattgagactgatagatctataaacccactttctgtggtacatgcagtctatattcaatattccgtgcagcttactccacaagtgagaggagggtctaagcttttgagcatagggatggttttagaaaataattacatttaaaaagcaaaatggagacctgttgagaataaataaagtcttgtttcttatagttgtgaatcttttatatcaagacttcacctgaaaaactgctagattgtgcttcaaagcactgtaagttctagccctggttctataatgttatctaagatatttatcatcattgagttctctggactcaatgttcttatccgaaaattgaaggagtcagatataatcatttttaaaatgttttccaaaccaacatcctaaagtcnactctcga

SEQ ID NO: 2259 - DNA, 1272 bp, Homo sapiens
  misc_feature (1209)..(1209): n equals a,t,g, or c
ggaactttaaaaactcctcagagaatgagagaaaactttaccgcgaaggtgtggctggccattcctttcctcgcgttggggtttctctgtgtcagcgagcctcggtacactgatttccgatcaaaagaatcatcatctttacctttggggaaaacaggaagagggatggtgctttatcaatcacatacttagcccaaacaagtgccttggcctcctcagaaatttaaaaggtagaaaaaaatggacatatccccttttaagaagcttccacatcacatatttttyaaaaagtatttacatttcagctgtcatgcaaatcaacagttttgccaacttctttctcctttgctctggcactggcattaacattcttcctcactgtggccctggaaatcctcacactaatgaagcagcagaaaggcccatcacactgcactggtgtgtggtcttcgcatttccttgactttcttttcttttttgttctttcttttttttttttttgagacaaagtcttgctctgtcacccaggctggagtgctgtggcgcaatcttggcttaactgcaacctctgcctcgggttcaagtgattcttctgcctcagcctcccaagtagctgggactacaggttcacaccaccatgcctggctaawttwtgtattttttagtagagatggggtttcaccatgttggccaggctggtctcgaactcctgacttcaagtgatccgcccgccttggcctcctgaaatgctggaattataggtgtgagccaccatgcctggcttccttgcctttcctttgtgagacacggcaacagcccaaggggtctcagatgctgaccctcagcagagggcacctcctggggccatggctgtgtagctgggggcatctggcctcacatcctagttgagtgttggtgtccaggtggctggtgcaggcacccgcccttcttcacttttgcatgtcttctgtggcctgcctgactggagccagttgtcagggctcctgagagctgactgtgggcacctcttcctgaccccacgctcggtgacatcagctgggagcttgcgatcagccagggtgggagcatttacgccacagaacctggcacatgctacaggccaggactttgtccttttccttttctgggagttggctcagcagcgtgctcctgttgtgctgttcccctctctgcagggtcatgtggccntgcctgccggccctccgtccccgctccaggactaacctctgtggagggaatcacctaactcga

SEQ ID NO: 2260 - DNA, 536 bp, Homo sapiens
tgcaggaattcggcacgaggtaactctgagccagtggcccccaaggtggcagaacaggtgtcagccacatctagaaggaggcctagggacctgcagggtgccacccttggtgaggcggctgtgggccacccttggtgaggcggctgtgggctgtgggtgaggcagccccttggtgaggggctgggaggagtgggcttctctcggcctggctgggagtccaggtgccagggtcactaagacaggcctggcatgcgggtgtggaggctggcatggtttgcttgggcatgggtggggcatgggacaagctgcacaggtgtgcagagcactctccacatagtcactccctcttaggaaaagactccttcctccacttgagagggcatcaggccagcagggaccagacgttcgcctaatccagaggctgtcccccaccagataagggcgtagccaggcatgctgtttaccatccgtcctcaccaaggactctgtggccataaaaagagcagggcttcaccagctcgagggggggcccggta

SEQ ID NO: 2261 - DNA, 393 bp, Homo sapiens
aattcggcacgagctcacctgtccactagcagctggacgggaaaatggcaaggggtcatttcctgtactgtaccgtgaggcagtgattagctacgtgtggctcgtccaactagagatgtgctgtgagtgtaagatgcacactggatttctaaaactttgtgcaaagaaaagggaaatatctaattagtaatttcatatggattctgtgttgaaatgacaatattttaggtttttgagctaagtaaaaatacattatgaaaattagtttcaccttttttattctacttcttaaaaatgtgcttgctgctagaaaatttaaaatgatagatgtggcccatattatgtttctgtgtgatagactgctctggatcaagagtcggcaaactatggccc

SEQ ID NO: 2262 - DNA, 688 bp, Homo sapiens
ggcacgagcagggagaatgagactgagagacaggagggcaggagaaggtcagagacaacttttgcttctgaggctgctgctgaggacttcattttggggcgttgttttctgagccccaacagaaggaaggaagcctctccctccaggggtcagtcctgggcctcaagggcaccctcgaagcaggcagctcagctcacagagctcccctcggccatgtcctccacctgcccttcctttgtccagcacctcacctgcacacacctgtctggagagtccccaaggttggagagctgctgagtcagctgggccgagcacacagcgcaacacttccttgtgcctcctaaccaggatgggcgacaccagcccattttatggatgggacaagaagaagctgggctgacaagcccaacatagtggagccagcaacaggcttttactctcctctctgtctctttgtctctctcctccaccgcacctccatccgctccattctcctctctgcacatcagcttcccagacaatattcttggtttctgtggctcccaaactgaagcttccccacagtggctgcaactatccagacctggggccacacttgggcctccaggcaggggatctagtgatcactttctggtcatgtcatcaggccaacttggctgagctctgccctccttatctctcctctccc

SEQ ID NO: 2263 - DNA, 1430 bp, Homo sapiens
gcagcctccagagtaaagtgaaggcgcaaagcctcatgcaaacatcgaggaatgccttcattgtttcgaggtctctcttcctggcctcccaagcccactccctgccccaagtgccacccttccctggcacctgatccctgaggacgttgggtcctggggtgggggcctctgggctcttcctctgggtcccaggagccccctccccactctgtggccccagctccagacttggcaaggcaagccggagtgaggtttctccactccctcccaagtgctgtgctggcggctcccgaaataaaaatcaaatgtgggcttggcaaagggagcggggtgggagaagcagcggcagcagggctggggcttcattctttccattgtaacttcacctcctaacctctggcattttaattatgtctcctacccccctcactctgcctgggccagggggtgagctcaccctttcctctagcctgggagggggcagctgctgcctggacccccagtccccggcctgctcgggggaatctgggtggcggccatgctgggggtgtcggcctcaggctccctccagcttctccagtctcagaggggcctggagaggggcccagcccccagacagccagccgacacctcaagttccatgtgtgaatcattagtcttcacacccactgctccatttagtggtggccactgtcctaaggcaaggcacggcaggctcaccagcccattctatggatgacttagccatcatcgtctgcagggccaagcctgggcccaggcctatcgctcttggttctgcactctttccaaacccaggaagacgggcaagaacagctcaggcctgataatttgccttatctcttcgagtgtccgtttttttccaatggtaagtgatggaaagcattattttgatactaaaacatacaaggacatagcatggggtaggaagtaaaatgcctgtgaaagttcaaggtagaaaacaaatcctcaaggaagatctcgtggggctctctgcaggcgggccccagggagtagcatcctcctccttggcatggctgtggactggagtgagatgcagtcatatgtgtttgtagccagtttgtgcagacccaaggctgctgtggaagatgccagtgggtgctgggtgctgggtgctggcaggcagccttggcccaccccaggatgcagaggccttcttccctccaaggcccacagtgggagtcctgccgactctctccgtctcctggggagggaaacctccacaggacaagcagcctgtgtgggggtgggggctgcctccacggacagtgcaggcacagggcaaccttgactgtgagcccagggccagcacccaaccaccccaactgaggcttcctctccatcctctgggaggtcccccgccacactgccttagaggcccagcccctcga

SEQ ID NO: 2264 - DNA, 1803 bp, Homo sapiens
  misc_feature (18)..(18): n equals a,t,g, or c
  misc_feature (24)..(24): n equals a,t,g, or c
  misc_feature (46)..(46): n equals a,t,g, or c
  misc_feature (106)..(106): n equals a,t,g, or c
  misc_feature (1788)..(1788): n equals a,t,g, or c
caccctgggcgcccaatncgcaanccgcttttccccggcgcgttgnccgattcattaatgcagttggcacgacaggtttcccgactgaaagcggcagtgagcgcancgcaattaatgtgagttagctcactcattaggcaccccaggctttacactttatgcttccgggctcgtatgttgtgtgaattgtgagcggataccaatttcacacaggaaccagctatgaccatgattacgccaagctctaatacgactcactatagggaaagctggtacgcctgcaggtaccggtccggaattcccgggtcgacccacgcgtccgcttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaataaaaaaaaaaaaaaagcggccggtctagaggatccaagcttacgtacgcgtgcatgcacgcatagctcttntataggggacctaaa

SEQ ID NO: 2265 - DNA, 1149 bp, Homo sapiens
tcgacccacgcgtccgcccacgcgtccggatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggataggagtgctagaaactatttatttatttttgagacagagtctcactctgtcacccaggctggagtgcagtggcatgatcttggctcactgcaaactctgccttttgggttcaagcgactctcgtgcctcagcctcctgagtagctaggattacaggtgtgtgccaccatgcccgtctcatttttatatttttagtagagatggggttttgccatattggccaggctggtctcgaactcctggcctcatgtgatcagcccaccttggcctcccaaagtgctgggatttcaggcgtgagccaccacacccggccaaaactgtttattcttgagaagttccatcttcatttctgccacagttggaacttcccgaggaaggaaggaggcctgaggttttgcacaatctgtttcagagcctgtttagactcaaacctatgcttcccttggcagcagaatacacttaacctaaagcagtatttggagttgagaaaaacctggtggggtaagtgaatatgtactgtttggtagggtaggtagagaagctgtgctttgaccctgtgattccatctttttctaccttctatgatggtgatgaagctagatacccctagggaagaaagaaggactgggtttagcaaatgatttggtaattaaagtttatttgaacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccgctctagaggat

SEQ ID NO: 2266 - DNA, 2753 bp, Homo sapiens
ccacgcgtccggtacacactcttgtttggagagagtgtgttgaatgatgcagtggccatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgtgagttcccgatgctggaaaccggcctgtttttcctgctttcttggagtgccttcctgtctgccgaggctgccggcctaacagggatagttgctgttctcttctgtggagtcacacaagcacattatacctacaacaatctgtcttcggattccaaaataagaactaaacagttgtttgaatttatgaactttttggcggagaacgtcatcttctgttacatgggcctggcactgttcacgttccagaatcatatctttaatgctctttttatacttggagcctttctagcaatttttgttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagagttggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagcagccattctgattactggattggctggggtggggatgggggtatcaggagtctagctgctggaggatgggacagctgtgctgggtcttcagggcatttctgctgcgaatgcggctctccaggcccttcacttctattctggattttattccctccattaaggagagtttaaaaataaaagaaagcttctgagagtaaacattttgctcctaagctgaagggaatgcacagctatttagtaagtgataagtttcttattttgaggacttgactcccatttgctctcagtgaccccagggcagagcccagagaagtgttccgtacccactgctgatggtttcccagagcccacactgagttgaagaacctattgttcttcttggcatccttcttatgctacttctcccatcgctcaaaggggttgcctatggctgggtgtgccctgccctaaatgcagcaccactttcaagcttagtaggaccattccaagaaaaccaggtttcttctccccataccacgttgtgcctgaagaacaagccttcccgtccttgcctgcatgtgagtcacttcttggctgtgcagcaggtccccccctccccgcgatatgctggagggtaggattctgcagcctgtgttgctctctacctggcagcagactgtgcaggagccccaacctgtcctcaattccagcattcacagctgatgagcagtgcaggagcagggcgagaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactaaaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagtaaaaaaaaaaaaaaaaaaaaa

SEQ ID NO: 2267 - DNA, 1247 bp, Homo sapiens
ccacgcgtccgcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcggcaaaaaaaaaaaaaaaaaaaaaaaaaaaaaaaaa

SEQ ID NO: 2268 - DNA, 1154 bp, Homo sapiens
cccacgcgtccgggggatcgcagccaaagggcggacgccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgtacatccaccttgtcctgggagggacatcaatgggtttccatgtcctttggcttctggttgagttcactcagtggagaaccctggcaagaggcaggaaaaggggaggaagcagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaagcagctgcgtgaacagttttgatgcaatcatgaagcagggcccagtgcctgtggcatctgcctttttctggaccaatccatatttccttgtggttttctaaggtgcagagagggcacattgggaactttgcttggggtctttttcacatcttagagggaaggtccctcaacatctgcattggcggagtgtgatcctcatgtccctctgaatgatctggacttgaggtaaccagccccttccaggaagctgtcccatgagtgaagcctcagcagcagcctctgtcagtccctcccccacagaacctttggcttccatttgaccagccttgacatccagtgtccaaacaccgataaaattgattccactaagcgtgggaaagtcctggagcatcgattgtttcctcctctgcacccccgataccctggcattagcactctcccagaatgtaccttgcttgtttgattggaggaggtcaaagccctgatgaagaatgagtggaattccacaggattggagcagtcttgataaatgacagcaggggatggtgtggggaggggaaaggatcagaggaagtgtggataaatgaatggcttaaaaaataatccacctttgcctcccccttttctaccagtctgtctagtgcttcagggtgaaaaaaaaaaaaaaaa

SEQ ID NO: 2269 - DNA, 4024 bp, Homo sapiens
ccacgcgtccgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtgcagacaagatgcgatttgatgagatattcctgaagaccgacctggacctggatggctacgtgagtgccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagagacaacttaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaagcccctccacggagcccccgcgcctctgctagtgtctttgtgcctcttgtcatggtgtgggctgccaggcgtaattgttcatgtcacgtatgtatctccccggcacctttccaacacaaggtcaggtctggaaagcatccatggctgtgatccaatgcactgcagtcccgtggggtgagccctgacccttcccagtggcataggtgccctgggctcccctggctcccactggtgtctgacgaccatcaggtctcagacggtgaagtcattgccatggccgagtagaaacttgagaaggcgttgggcacaggcgtctcgagagggccatgggcagcaggcctgcaggtcgaggcgtccagggaaagtgggccagcgagtgttcagagtcgcccatgtgacagaactctcaaggggtgttgaaaagtgagggccggcctccttgaataaatgcagacagatccacaggtgaggagtgaactgttgaaggaggacagcagcgaggctggttaccagactggacccgttggtgtccggccctcaccacacggtgacctgaactcactgtggctctggtcccagacagctgtagggcttctccagacgctggcagtgtggttggagctcatctttaaggtagcatagagaattcaacagggaacatccagaatggacaagtcaaaaaacaacaatagaagccccttacgactgaggtgccttccggaagaaactgctggaaagttggaaatgggggctgtggtgagtgggaaggacagggctgcggcaccattgtgcttccttgtgagttgtatgtttccctgtttgagtgaggagcatttttctttggcaggaatgaaggaaagcagatgaggtgtgtcccgtccctgacacctgcgtccactctgtcccttctcggcagcccccaggcaggggcagatgggctctgtcttcgggggctgcaggggcctgctttcctcacgagttccacctgcagaggcccaggcattatccacgctgcgggaagaggcagtagccacaagcagaacacagcccccctcctggagcccatggcccaggtggtaaggggtggccggtgtggggggtcccctggagcagctgggcccagtccctgtgagcgctgctgtcagcctgaaggtggtaagggagggagccccgggagtacctggaagacgcgtgccccaggcatgaggccccctcggggccccaccggccccatgcccaggtgccccaggtgccagtgtgactgggcagtctcccttggctgccccgtgttcactcagctggtggagcagatgagtctctgagcatcttggggttggcagcggtcgcaacttgtgatcacagaacacagattccgagaagcacttgagattctgttcaggttttcaaagacgcgtgtgtgcgtgccctggcggcgcagcagatcccacttctgaccgaggcagggtgtgtgtttacacagatgagcctgggcagagggagcccagaggccctggcatggcgcccccctccttccagcacacggagaaggcctccatccctcatatgccacgctgtgacacggtttgggactggcagaagatttagggcccagtgcacaggctcctgggcaggcgggaaaccatctcccgaaagcagaaaacgttggcacacggtggcagcagtccctcaggcgtcctggtcgtttctggttgtcgcaagtggactcctcttcctttgggaggctggatctgtcttcctcctctcactgtgagcagagggagggagagctagcagagcctgagctagggccgggatctaatgaccgccctctgcctgtccttgggccctgaaaccaggggctcttcacacacatgcagctgtgatttcagagccggtctcacttcctattggcggtgccgggccaggacagagttggacagagctgtggaaaatgggtctccaatactatcttgttttgattccagcgttccatcagctgccttcatgacacttgtacagccgcattctgagctcaaccctgaccttgcagctctgtttttcctttttggttacctatctgtttttcaagaacaacattgtggatataaataaaatgctaagggaaaaaaaaaaaaaaaaaaaaaaaaaaaaaaaaaaaaaaaaaaaaaaaa

SEQ ID NO: 2270 - DNA, 2287 bp, Homo sapiens
tggacgaggtggaattgctggatctggagagcgtagcgcctggcgggacgaggacgactacacctggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagatarccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaaaaaaaaaaaaaaaaaaaaaaaaaaaaaaaaaaaaaaaaaaaaaaaaaaaaaaaaagggcggccgc

SEQ ID NO: 2271 - DNA, 755 bp, Homo sapiens
ggcacgaggcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtcttggcaacacagtgagaccccatctctacaaaaagttaaaaaaaaaaaaaaaaaaaaa

SEQ ID NO: 2272 - DNA, 522 bp, Homo sapiens
caccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatcacaaaaaaaaaaaaaaaaaaaaaaaaa

SEQ ID NO: 2273 - DNA, 787 bp, Homo sapiens
ggcacgaggtgagatggactttctcagaatatgaggactgcatgcttggcacactttaaatgtgtgtttcatttttaaagaggattaaagccctcatatggttcttttcctttaaaaaattattgaaggcagcacaaattggtaatacaaaaaaatatggacatgaaagctaatacctaaatagattaagcagttaacagcagtacagacaaaacttaatgaacccataaaatagaatgtggcaattcacattgaaatgatggaagttctggatgaaatacacagaaaacataggcaaggaaaatagtcaaaggttttcaaaactggaagtggaaacaaagatctcagccagactgttaagaaagtgtatagagtgcctctcagcataatgttcaaagatagacatccacttgtcaatgtcttaatcacagagtaaaaatttattttagaaaaataaaacgacaactttactcagatgttatagaaaagatgccaggtgcggtggctcacgcctgtaatcccagctctttaggaggccgaggaggatggatcacgaggtcaggaggtcaagaccagcctggccaagatggtgaaaccctgtctctactagaaataaaaaaattagctgggcgtggtggcacatgcctgtagtcccagctactcgggaggctgaggcaggagaattgcttgaacctgggaggcgtaggttgcagtgaactgagatcacgccactgcactgcagcctggcgacagagcgagactccatctcaaaaaaaaaaaaaaaaaa

SEQ ID NO: 2274 - DNA, 1241 bp, Homo sapiens
ggcacgagattttgcccacatgaattattatttctttttcaaagttacaactttggactttgctatctttcaggttttgctcgtaatctgtcagaaggcaataatgctaattacacagagtacgttgccaccagatggtatcggtccccagaactcttacttgggtgagttaccgtcccaaaatagaatgacatttccacatctgctgattctattgtcatttgctttgagttcatctatggaaaataagaacttcagttaattaaatgtgtcagttacatattgcagtataacaaactacctaaaacttaatggtatgaaacaagcacctttttgtttgctcagaattctgggtgtgggggaatcaccagtttgagttcagctggatggttcttctactggtctctcttggagtcactcacgaagttatagtcagctggtaggtcttctgggagctggttagtttaggggtctcagctggatcagaccatctctgatccctggaaacttatcctccagtaagctattccaagtttctaagtgtgatagttggagaattctgtgctattaagagggtaagccccaaagcaacagcagctttcaagcctttttttgtatggcttttgcctcgttggccaaagcatgttacatgaccacccctgattcatggtatggagaaataaattccatctcttgatggggcaagtggcagagccatattataaaatggtatatgtatggaaatggaagaaattaattgtagccatctttgctaataaacttccacattaagaatgtgaatatccacacagtttgacattctggcttatctatttgttcatttattaattcttcaagtacttatcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacctgcctgtagtcccatctacttgggaggctaaggcaggagagtcacttgagtccaggaggcagaggtcgcagtgggctgatatcccaccactgcactccaacctgggcgtcagagcaagactccatcacacacacacaaaaaaaccccaaaaaaaaaaaaaaaaaa

SEQ ID NO: 2275 - DNA, 1093 bp, Homo sapiens
  misc_feature (553)..(553): n equals a,t,g, or c
gaattcggcacgaggcaacttctgccatgtggactcaaatgattcatctcagcctcccaaactgctgggattacagtcataagccaccacacccaaaacctagatcttggttttagattagatatatgtagaacaaagctcccacgtaccctctaggagggaagatattaccagaattatgatgaggtcccaagatctcacaggctttgctgtgtgctggggacagytcatyatcctactaattcttgactctcagccttaggccaaggagaattatgtatcttttataaaagatatgtaaactacttgagrtagtttcaagtgaaacaatcggctgtttgtgaaataaagaagaaaatttgtgaaataaggaagatttgtgctgcagagttctttagggatacgggctgcagctgcccaggtgatgagcttgaagaacctaggcccggctggcagagtggagaggagctgggagagacagctgcttttacgactctttcatgttctagcagatgccagatgcgaggcttctccttacagggaagggttatgnttgatttatcatacatttctggagtttttgkttagtttttgktaaatgcaaagctctgkgctggacattgtgagaaacaggaagttgaacgcccataaggagtttagaatagaagtggaagaagtcagtaggtgcccaaatgctatttgaggtttgaatagagaatgggtagaggggagtgtcaagggtaggctaagtttggagttacctaacctcaaagttccaaactgggagactggtgttataattgggagctactgcttttacagtcccctcctaagtgccgtgtgttcccgggacattgggaagcaggagaaaatgggtggtgaaagccaggtggcttctaagatccatgtcagttctaacacttttgacatctacgaatgattcagcatggttgtctctgaagcatgctgcaaatcacctctcgtagcctgcaagtacctgtaggggctaagctttgtagatgccacaggtgctcttagaaagcaaggaaagaaagaagagagagaagaaaaaaaaaaaaaaaaaaaaactcga

SEQ ID NO: 2276 - DNA, 553 bp, Homo sapiens
ggcacgagggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggactggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgcgtctgctcctggctggcccggcctaataaagcagtgttgccatctcaaaaaaaaaaaaaaaaaaaaaaaaaaaaaaaaaaaaaaaaaaaaaaaaa

SEQ ID NO: 2277 - DNA, 1503 bp, Homo sapiens
ggcacgagcactgttaccgagatccctgataccattaatgatctacaaggttcaactaaggttttgcaagcagtgcagtggctggtttcccactgcccccattcccttgacctctgctgccagactctcattcagtacgtcgaagagggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgcctggaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaaaaaaaaaaaaaaaaaaa

SEQ ID NO: 2278 - DNA, 605 bp, Homo sapiens
tttgagctttggatatgttttatttaatgtggtggcaattcatccaaggggtgatgttctcccagcatttggacacacagggaaacttcctcttctggggagactcagctccttcaggctggcggtgagcgagggcgccgactggcccagggcctggctgcgcatgcgcacgaggttggacgtctctgcagaggccggccaggcctgtcccgccaccgggtttggaagaaggtacctcccagtcagggctcctcccaggctccctcgccttagctgtcttccatcctcactcagctgtcttttatacttcagtgattttccagggccagaagccacatctgggttgctgcatttccgaaacggcatgggtggaggggataatatgtggtcaagccttcactgctaccttgatcttttgaaaacagccttccatctatcacctgtgaaaaccagtttcatctctgtgtatcacaccatctctaggcttcacacttcatgactcaaactcttgaagaacctgacaagcgtttccaaagttcttcaaatgcttctgcagtcattatttgaccctcaaattaacaattctctgcggcaaacaagcggca

SEQ ID NO: 2279 - DNA, 1156 bp, Homo sapiens
ggcacgagtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatgggccagacagacaatgggggttatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagataactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaaaaaaaaaaaaaaaaaaaaaaaaaaaaaaaaaaaaaaaaaaa

SEQ ID NO: 2280 - DNA, 1357 bp, Homo sapiens
ggcacgagtagacacccagggatccacctggcataaaaatgcaccctcacttcttttgcttgaaaatatttacgaaggtgattcttcttcaagttttttatactggatttatatgtgggcaatgccggtaaagtgtgcttttcttcttccaaaaagtamcattttgagatgatcaaatggaagtggcctattctatgctcttataagcctgggagaattctgtttttctgttgttataattgacttattggggtttgaaggtgctaagcatgggaaaacttatgttcctgaataagatattaaatttcttagctttggttctttttagaagatacagttaaactgcagggaagtgatttttcaaattatgccatataaggtgattttagtggtctttaaaacacatgtggtagattttaaatgcctcaaataatctagacttgtgattctcagtttgsctgtacagagagtcacctggggagagtggggtggtagtgcttttaaaaatgcagatgctggagtccccttagaccaattaaatcagaatatccagagatatgaccagaatatctgtacttttaaaacgcctcagatgatcctaatgtgcagccagtgttgagcttctgatgtatgaacaaaaatataaaaacctttcacaagttgcccccagttcatcgtccattcaatactgtatagaacagagacaagccctggccaaattgcagagtcatgtgcaaaataaatgaatgttgttgtttcaagccaccgagtttagaggtggtttgttatgcaacagtacataactgataggctaactctgaaatgtcttaaatctgttaccatctctccattcccccaggacaggctcttgttacctttgttgactggatccacccaccttggcctcccaaagtgctgagattacagacgtgagccatggtgcccggcattttaaattttttttttttaattaattgccaacactttaaacactggagagttcatataaaaatctggatgtctagcacctcttgagaactcggcatatgtggccacagtgggtccacaatttctgcacagcagcaaatgaggagacgcagtgcatgtggcactctccaggtggccaccctcagccactcacatgcatattcgtttctgtggcccactgctgaagaaaggccactgcggggcatggtgccatgtacctgtggtcccagctacttgggaggctgaggtgggaggatcgcttgaacctgggaggccaaagttaaagtgggccatgatcgtatcaccgcactgcagcctgggtgacagagaccctgtttccagaaaaaaaaaaaaaaaaaaaaaactcgag

SEQ ID NO: 2281 - DNA, 739 bp, Homo sapiens
gaattcggcacgaggggagtaaggcggactgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggttttgtaacctaccaaaatggataggctgttgaacattccacattcaaaagttttgtagggtggtgggaaatgggggatcttcaatgtttattttaaaataaaataaaataagttcttgacttttaaaaaaaaaaaaaaaaaaaaaaaaaaaaaaaaaaaaaaaaactcgaa

SEQ ID NO: 2282 - DNA, 991 bp, Homo sapiens
  misc_feature (979)..(979): n equals a,t,g, or c
  misc_feature (990)..(991): n equals a,t,g, or c
ggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaatatgtcattttatgtaagggacttgagtatacttggatttttggtatctgtgggttggggggacggtccaggaaccaataccccatggataccaagggacaactgtacttatttacctttattgtcattgcaagcttcttatggaaatttataggaatgaaaatatacatgttaagaagattaaacattagatagtagatggtttgttgcatgctagaactgttagtattgttgaatcaattactttggtttcatgaaaaaataaacgataaatatctttaaaaaaaaaaaaaaaaaaaaantcgaggggggnn

SEQ ID NO: 2283 - DNA, 3287 bp, Homo sapiens
  misc_feature (1412)..(1412): n equals a,t,g, or c
  misc_feature (3169)..(3169): n equals a,t,g, or c
  misc_feature (3246)..(3246): n equals a,t,g, or c
  misc_feature (3273)..(3273): n equals a,t,g, or c
atagtcttttctatttttcatctgtcatcagtgggagggtgtaagccattgctttcagaacagaatcggcagtgtcgctcacagtctttctactaaaccagttgcatcttacagagcagcgtggatgagtgctaagaaccggctgtgtgaccttcagcaaggactttctcaccacaaaaatagagttgcccaaagtcaggcagaggtgataatgtgtaaaagtgactggctccaggcagacttgtagtgaacattgtttttcttccttcctgctagaaatgagtataattttagacttatgtttaggttatgaagagcaaattgaaaagagcacagggtttccagaccaggagtctggagtggcatttatgagagcctgccctgaaatggcactcagtgttgtcctaaggtcgcatggcctctgtgggccatggtgggcttcagtgggcctcagggctctcagtcataaaatgggaatgtctaccctaaccacctctcaaggccattttgagaacagatggccaatttacataaaagcatactatagatgtaaagtaacgtcatacggcttcatcatcaacccctacatctatatgctttaactgttttagagtacattgatctcatagaatgttattgcctcaaaaatatccgtttattttcccagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaaraaragcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacamattgaagcgtttccagcaggagaatgaagaattgamagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtaggtaactggagcgtcaccaccggcggaatcgnagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctagggcatgggtaaatcttgtgttgttccctgctgtcctccgtattacgtgaccggcaaataaatctcataggcagnttaattataaaacmtctttgggagggtggggaggaggacaggaggggaagktggggggaamcaaattaggggattcnttaagggatttttgttttaaacccaangttttcctgtaggg

SEQ ID NO: 2284 - DNA, 2621 bp, Homo sapiens
  misc_feature (2102)..(2102): n equals a,t,g, or c
tgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcargarcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagrkggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggsttctgcttcttcaactcagtggycatcgyctgccggcagctgcaacagcagagcaaggycagcaagatcctcattgtagactgggacgtgcaccatggcaacggcacccagcaaaccttytaccaagaccccagtgtgctctacatctccctgcatcgccatgacgacggcaacttcttcccggggagtggggctgtggatgaggtaggggctggcagcggtgagggcttcawtgtcaatgtggcctgggctggaggtctggacccccccatgggggatcctgagtacctggctgctttcaggatagtcgtratgcccatcgcccgaragttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccycaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagangcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggartagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaaaaaaaaaaaaaaaaaattact

SEQ ID NO: 2285 - DNA, 745 bp, Homo sapiens
  misc_feature (18)..(18): n equals a,t,g, or c
ggattacctgagatgatncctgtagggactccagcataccatctgtgtttgcwatagttattatattacttctaaagtcagaattaaagacctcaaggcgtgagcaccgcacctggccctcaccaaattcttaataatggctacctctagagaatgagaaacaaaaacaaaaactgtaatgtgttcattggtagtagctctttacctaattccaccctttcatactgatcagcttcttcctggttcatctccattgttatcagtagtcaagtcagtcaccaacttctggagatccttcaacttgtaggacaatatccaatatttactgttaaatccatgtccctttaaaacttgccctctagccaatcttcataagctcttcttgggagctgctttctctgcctcagccacaatttctgtgcccatctccctggaacttaagccagtgaactcaccaggactgtatcacaccatattctttcaaaacaggctcacctctgtgcctggaaaacagcccatctttttttctatgtgtattagtagaaaaaaaggtgaaatgactgtgatcatgaataatccccacctctcagtggcttaaaataacaaaggctcctttctcactcacagttgggcacgtctgtccatttgcaggtgggttgggaagctccattctgtatcaccctcgctcaaggacctggactgaaggatttctgctttcaagaaaaaaaaaaaaaaaaaactcgag

SEQ ID NO: 2286 - DNA, 931 bp, Homo sapiens
ggcacgagcttaaaagccatgtagttaagtcatataaattccaaaatgtatcagtttcttctgtgtaggtaagtgactagtaatagaaactaaattattaatatgtactagtgggacatagggaagatgtaagtaattaccatggtgcctgtgtacaggtctccattgttttggggcaatgaatatcgaatgctttctcattcttttcctcttttcccaccaaattgtgatttgtcactcctctccacttctttttgttctgcattttttgttgattgtttagagctggtgaacagcaactatatttaaaaaaaattgaggccaatttggtaaagaaatgagaatctgaattccagtttgctataatttaagctatttattaaatataaagaagtggtatttaaaattctcaggtattgggaaatcttacggtatgttttaaaggracagtttcttaaagtcctaatcattgaattagggagacatagagtctcaaatataagtgtcatttgtatgtattttcttcaacgataatgtttggcatttggatttgattttattaacttaaagtttttaggcagtatgttaaactggctcaatgcttcgtactagttcttttacacaacttgccattattgagttattttctgttgcagaaaaggcaatctctttcacctctggatgactcaaatcaggaaatataagcaaaagaagataaacaattctttctgtgtctttacttctcagtctttcccaatctggctgaggcacataaagcagacttgaggaaattctttacttaggacactatcttaacctgctcagggtatttagaattttttgaaataagcagtcatgtacttctataagtgctaaggaaagtaaattagtgtattattaaatattagatcttaaaaaaaaaaaaaaaaaa

SEQ ID NO: 2287 - DNA, 635 bp, Homo sapiens
ggcacgagcataattatcaaaaccatgaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatctaaaaaaaaaaaaaaaaaaaaaaaaaaaaaaaaaaaaaaa

SEQ ID NO: 2288 - DNA, 1187 bp, Homo sapiens
ggcacgaggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaactttaaaaaaaaaaaaaaaaaaaa

SEQ ID NO: 2289 - DNA, 921 bp, Homo sapiens
ggcagaggtaactatttgtggcaagccaggtcgaggtcactctctttgagggcatttactcactgcctagtgccccctttccactggggcagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcagagaacagtggccactgcatggttctcatgcttacagtacgatcctgtagctagatttgttttgtaagaaggaagaagaatgagatgaaataccctatgtataatgttttatgttgctttggaaaagtacaacaatgtagaaaaaggtgaaatcatgataaagtaagaaattaaaaactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaaaa

SEQ ID NO: 2290 - DNA, 960 bp, Homo sapiens
tttttttttttttttaaaactacaattttgaacatttaatgaatgacaaagacataacatcctctgaaaaatctgcaagtaaatcaatcatttttaaacaatrgctaccatatatttgtatcttctccttgggaaaaactttggaaaaaaaaacacgcacataagtatcataactgagggttgtggacaagttacttctattttaccaatttttatattgacataaagtagcacagactagttatttcatttaaaaaaacacactgacaaatcttttctctattacacttataagacttttcacttatatgcttataccaatatagaaacacataacttgagattctagccaatttttattttctcgaaactgtttatcacctgtgtattatctcagtttttccattttcctgcctgcttcttgatgtctgcatttgggccaattattgtttctcagcatcaccagcatgtggacaaaaaataagatgaaaactaaagtcagttcatctggtaattgaagttttgttagaaggactgataggagataatgcaagtaatgtctatagtgaaattatatgattattgatgaatctcaattattactaccactttccccacagataactgagttttgtgtgcatatgtgtgttttcctatggaatggaacataaaggraaattttaaagatatacaaacacatgttcaagtgtataatacatatgtacttttagtttcattttgataaaattaatgagatacaaattttatcatcaatttcagaggtctttgtatctagttctttatcaacgaaaataatcacaatatattgggcactgagtgaatttgtcagctatggattcgtttctgaaaaagtatttctacagtattcctacactactctgaagaccctacagtatgccatttttattattaaaaatagaattacagttgaggagagac

SEQ ID NO: 2291 - DNA, 869 bp, Homo sapiens
ggcacgaggataaatgagcatttaggaggccagccccataaacatctagccatatagaccccttaacattaaatgagttgctctcaaactgaatgtctagactttaacagaaaagagatacttaacctcagggaaaccatctatctgtccaaattatccaataattgagtttcctaagcagaaaattcaatgcctaacttcaagtttttctttcacctttgcattcactgggaatttttaatggaagccatcttcacctttacggtattaaatggtaaaatatagattttcctacaatgcatattaagtactgtaaaaatttctcttgtatgggtattagcctttaatttgtgcaaacagtagatactaaaaaagaatactaaatgaggaaactccaaagaagcattttctaaaacatgttcaatggaacaccagctccttgagatgttcaaaggatattcctcagatagggtatacattgatcaataagtttatgaaatttgggccaaacaaaattaaacaggtttactgacagaaccagcctgtcagagcctttaaaatgcaaacccaccttgtgaatctctatggtaagacataatattcggtgtttaccatgcatacttaatcataaagctgtcttttcttggaacatcttacagggcttgtgtccccagtacaaactttagaaaatgtagccttaatacccttcacattactccaatctaccactctaatggcttgtctactcttcttcatacatgactagcaaatggtggtgtttatgctttaaaagaacacagatctaaaaaaaaaaaaaaaaaaaaaaaaaaaaaaaaaaaaaaaaaaaaaaaaaaaaaaaaaaaaaaaaa

SEQ ID NO: 2292 - DNA, 799 bp, Homo sapiens
  misc_feature (19)..(19): n equals a,t,g, or c
  misc_feature (22)..(22): n equals a,t,g, or c
  misc_feature (45)..(45): n equals a,t,g, or c
ggggggggaaaggaaaggnaanaactccccttactattgggaacnaaagctggagctccaccgcggtggcggccgctctagaactagtggatcccccgggctgcaggaattcggcacgagggaatttcacacaaaccccactgtcggccaggctggacccacagtaccatgtggcttgcatgctagtgggggcccctccagatgaggtgggttctttcttttctttggtgcctggcccatttcagcctgtggtgctccctgcttgatccctgtcgccatctgagtgtgggatctcagccatcggtttccttagttttcttgtcagttgctcagactttcctctttggggcgttagaacacctcagccctagattttcttgccaggactgtgtagtccagttgggtggagcaaagcacttatgcctcaaatgctcagggcctggttaccatctcactggctgataacctctatctgaaggccactgtttccctgaccttccctccctcgcccacacacccacttccttccactgtgaaagcggagtaaggctttaattgcacaggttcatcatttcttgtttggaagtcttcagatttttagttttataccttagctttctgcagaattctccgttgaatcaatgccctgggaaccccatggacagaagcaccttttaatgaagtccttccaaaactcgttcctcagtgcattgctctgttggaaacagtgctgtggggtgttggggtgtatagtatatwttaacatattttaacttaaaaaaaaaaaaaaaaaactcga

SEQ ID NO: 2293 - DNA, 1804 bp, Homo sapiens
gatatcaagcttatcgataccgtcgacctcgtgccgagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacccgagggaggtgatttgcatcatggtcatgctgcatgggctccactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccattcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttcttggaaacgggtgtccacttcctcttctaagtacctttttctctttctcctaaaggtgggactatctcctagtgtttaaatttgccagttactcgcccatgtatgtcaagcatagaaaaggaaatgttttaccttatctcctgtatgtatgatagaacttaaaagaaatgggcatttgttttcatagccccagcagagaaaatcctcttcatagattaaatgtgctgctgtggacagagggaaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaaaaaaaaaa

SEQ ID NO: 2294 - DNA, 831 bp, Homo sapiens
ggcacgagctcttgttcagattgcttgcggtttgaaaaagaggtgtgctagctttgcttagtttatttcttatttttggtatacatatacatatatataatattagaatgtgtgtactggaaatgctatgataggtattttgtgttaatccaaatgcaatgatagtttcttgtatgaatgtgcaagaggcctgtgaccgaatgctacgtttttatggtagtktaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctcaaaaaaaaaaaaaaaaaa

SEQ ID NO: 2295 - DNA, 407 bp, Homo sapiens
cggcacgaggtaatcagtaggcagaaatggttggaatttcctggtcccagtttcagatcatatctgtctttccccagactcctaacttcctgttgggacatcccttggtctggcctttccctccagagaagcccccagacccacccgcagccttgatttactgatgcctaatcttattttagtctttcacaccagtttttaacaactcgactgtatagatcttctggaaattttacccaaaaatgttagatgtgccatcccctcacaggggaaagtggtggggtggtgggggttaatgtgttgaaaatctatgtatcttgtattttatttgagtcagctgtgttttcacaacaactctgagagttaacatcatttctactttataaattaaaaaaaaaaaaaaaaaa

SEQ ID NO: 2296 - DNA, 1255 bp, Homo sapiens
  misc_feature (15)..(15): n equals a,t,g, or c
  misc_feature (20)..(20): n equals a,t,g, or c
tttccaaggaatttngggcnccaacccgtaatggctgtacctcttatacacacaagtatgaaaaatacccagcatgtcacccacgtgcagaaagtccttggaaaagttagatgttttggatgagtttgtgggtttcttttattattatgcttcataatttatacacaggttaccatttcagagtactcaaaggagatacaagctataaggaaaaagatgcttgttttcattttctaaaaaaaaaaaaaaagtgattgaaatgagatcttgaaatctgtactcaagtgatttcattaggtgaagcaagaaatgagaattgatttgaactgatgtgaattggctggaaagggattcttagatcagctaagtgaactttctggttttccggatgtggttggagcagctttgccgattacccactggttaacagcagagtcacagctagaatgtagctctcttgaacttccatgctgtgtatctgaagaggaaggtgctccttaaggaagcagagaggcttctcgggaaaggggaggggatccttgttgctcctgaggctttgacaagcccttattaatttgcattttaaaggcaggcatgcctgggtggcggaggaagtctgctgtttggaggagaggtgttgctcatttagatcacgatgcatccactttagtggccctagaaggtgtctgggtgcagccaaagaagtcatagttccctaccacatgtcgatgtagtcagcagacagcaagcacttgctgtgctcctgtgaaattgactctgtaccctgagtcgggggacacgagggtggtgctgaaatgtcagctcaccaggcagagctgtgctggtgtgtgcagcaggtaggctgggcttatgcaggtgcaggcgtagcctggggaactcagggaggtgaaggacagaagcggaggattcccaccctccaagcctcactgggagctgttgtgtaggatgtatttttgtatccagatttgagtcattgggtaggaaagctaaatttcttctagaatttagctggatttgaatttttatatttaaattcttgaattccctgctgactcttacggcaaattaattgaaattgkgaatttttctctggttactactttaaatatatcccattgttttatcattatttttcagaaattctctatttttgatttgtatttcaccctttcattaaatagttgtttaacagaaagctttttagcttacagaaaaaaaaaaaaaaaaaactcga

SEQ ID NO: 2297 - DNA, 1768 bp, Homo sapiens
ggcacgagtttctttaaagctttgtgatttttattaatgttattgttttgtcccaaaggaccagtgcttatatttattcattctaatgtgtttttgtttaaaatctattaatatatggtttcatcttcattctaatacttggataggctttattttgtttctcctagctttttggatacagaattaacttatttacatttattcttagcaggctataggctttcttataagcattgctttagctctctcatatgttgtgatgttcagtattctgttatgattttctagagttctgcaacttcgttttgttttatagttttgactcggtttgttttcaggaggcagtttttgcttattattaatttttatttattgcagatgattagacagtgtgataaatttatttctcctatcaaaaatgtattgagatttttgtttgcaccctgttatgtatcagctaaaaagtttcatggggtcttgaagtatattattaattttcagtgtatagaattcaacatttatcaattagatctatcttattaattatgtgatttagatcatcttttttctcttaagtctgctttctaaaagcatacagctggttccttttatttgtggtagttatgtcgtataaaatcacttccagcacagaattagcaaatggtgaatcattgctcctaggggaaatacaaaattagctttctatgagccactgataacgtttttgtcagctgatcaatacgtaatctttttaatgtgtttctgtttaaagatactgtatttaacatttgattcattagcattgaactcatagccagtagcactttaacttatacttgaattaagtttatctaatatacattttttctccaaaagtcatattgcagcctttttgcatgtaggaatgaacactaaacatgttgaaggggtcattgaaaacaccacattaccaaagcaaaagtacaaaaatgcagaaaatgcaataaatatgtagtcatgtgccacatacaacattttgatcgatgtcagactgcatatccagtggtggtcccatgagattataataccatatttttactatatcttttctattaagatatgcttagatacccaaatacatagctatggtgttataattgcctgcagtattcagtacagtaacatgttgtacaggtttgtagccaaggagcaataggctatctcctatagtctgggtttgtagtagactgtaccatttagctttgtgtaagtacacactatgatgtttgcacatatgaatcactgatgacactttctcatgaggcatccatcattagcaatgcatgactatcacagaaggacactttaagtacacaagtggaaacagaaggcagagtggctcattgttcagcctcagctgggaatgtgtgtgtcaggcaattcaaaatatttaccactctgcgtctccataaatgatgccaaaagtatcgtgagtgttgatttttagggtcacagaaagcctgctctggctgaagatttaaataagatctaaagatttataataccccaaatatccaaatttcaacaaaatgtccctcatgaccagaaaagaatcaggaaaatctcaactgaaatgaaaaatgaacatcaatagacaccaggagaatacagatgtgaattgtctgacaattattttaaagtagccatcacaagaaggctgagcaattataaacatacttgaaacaaatgaaaaaaacagaaagtcccagcaaaaaaaaaaaaaaaaaaa

SEQ ID NO: 2298 - DNA, 826 bp, Homo sapiens
ggcacgagctcgtgccgaattcggcacgagagaaaacacctaaagctgttttgagaggtttgtcattagaagatgacattttcagaccaagcacatggtttgtttcttaatgaactaagataacgagggaaaacttagtgacttcttaaatgtcacatccttctgctggtcaatctgaaagaagaatggattcttcagcagcagttttgggggtattgctcaaaaccttactacttctgtggagctgcctgctttttcccagccagctagttaagcctcctagtggcgctactgtgttctgcaacctgcagtgggcatggagagagagggccagccctgccttgcatgcctgctcctgagggctttgttctggggtccctagggaagcacatttctctggctcttctagagggtgactcgcaactttaggcctctgcgtctggtcttcctcctgatggatgtcgacctaggcttggtcatttgttccttcccaggtgtttatggggtttcctcattgttccctgatataattcagtttaagagttggtgacagaagcagatgccctatattcatgggatgttccatctcacttcatgacttactggaatcctaatttttaaaattttcacagtggaattaagacataatggatgactctagccagacatgctgacacatgcctgtggtccagctgcttcagaggctgaggcaagaggatcatgaacccaggaggtcaaggctgcagtgagctgtgatggcgccactgcatcccagcctgggtgatagagtgagacactgcctcaaaaaaaaaaaaaaaaaaaaaaa

SEQ ID NO: 2299 - DNA, 2243 bp, Homo sapiens
  misc_feature (19)..(19): n equals a,t,g, or c
ggagttccaagcccacggncccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacrggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctktcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaaaaagggggctaaagtaacactttcctacttatgtaaattatagatcctaaattcacgcaccccgtgggagctcaataaagatttactgaattgaaaaaaaaaaaaaaaaaactcgaggtcgacggtatcgataagcttgatatc

SEQ ID NO: 2300 - DNA, 968 bp, Homo sapiens
  misc_feature (953)..(954): n equals a,t,g, or c
  misc_feature (963)..(964): n equals a,t,g, or c
  misc_feature (967)..(967): n equals a,t,g, or c
ggcacgagccatgtgaccccaggtgagtctctgcttctctctgaacaggtacccttctctcagccagcttgagggttaaagtggatgctgggtgcacagcaggccttgcagggtatccagtgccccacctggcccccgtggaggggaactgctctgagttttgcaggaaggatgatccgatgctgctggagattcctttccatggaaatggccgctccccaggtcccagaggaaatgaaggcctgggtgcgtcctggctgtggcacctcacctcctgggcctccacctcttgctctcaggacccttgtggggatgagagaggggcgtggaagggccttaggcccagcactgcatgagtaggatctgcctttgggtctgatgccttcagatcagatgtgcctaggttcttccttttctgttcaccccgtgggcctggcagacctcgagagtttttggggcctagactgggaggctcagtggtgcaacggttgggatgcagggtcactgtaagtcagacaagcggcctgcagctcaagcctcagtgtcctcactgtggarggcggctcactcctcagctgacgtctgacaargacggagttagagaacctcctgtgtgctgagctctggccaggagcttccaccttcctctccctgagtcctggaaggtggtctcagtgatccctattttgcagatgaggccactgaagccggggaagggcaatgacttacccaaaatcatgcagaggcagcagcaggattagaaccagctcatcttcccaacctgcctgggcaatgtaatgagactccaacagaagaagaggacagcggcaaactgccttttcagaccctaaagcaagtgtaatattggctgcctttgttctgaaaaaaaaaaaaaaaaaactcgagggggggcccggwacccaattcgccctatagtgagtcgtatacaatanntcctttttnnccnt

SEQ ID NO: 2301 - DNA, 1532 bp, Homo sapiens
ggcacgagaccgtacatagatgtccaggtcaagttcttccttgtagttttggaaagaaatgacaaaagcaaatgacctctgagcaaatttttttttttcctgctccaatgggcttgcttttatggctcaggtgcttagctggtgtgctaaggagacatggctgctgttgggcatagctctcagatcatctctctcctgcccacagccaaactggtgggctccatgctgaactgaatgacctgaatactcgacctcaaatgactaaatgccacatagagctaatgtacacttttgttgggtgtgagtggaggatagttgagtaggcatgtggcacacagaggattgagaggcagctattatactctatttcccagggcctctggattaagtagaggtgggttaggattgacatgttgagggtgatgtggtattcttaattttgcactgagtaacagaaggtcttcaacaagtgtaatcagacccagtttatgtgtcttcctagattcacttggctctgtccaaccctagatcttagctgcttgtgccatggagagattctggccacctgctgtgtgagcctccctcagggtgaggactgggcttcggcctggcttccatggtacctgctgcagagggagctctggaggctccagtatccatgactgccccaactatacctattaaactacggctgttcacattgcttcctcctgaaatgaaatggcatgccttaggccatgaggtctgacttcctctgcagcttcctggaaggacttagcaaaccatttacccaaataaagtataggcgatagaaattgaaacctggcgcaatagatatagtaccgcaagggaaagatgaaaaattatagccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagcttctttggacactagaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaaaaaaaaaaaaa

SEQ ID NO: 2302 - DNA, 1874 bp, Homo sapiens
  misc_feature (1593)..(1593): n equals a,t,g, or c
ggcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcmaaagagactaatggatgaagctaagattttgaaaagccttcatcatccaaacattgttggttatcgtgcttttactgaagccagtgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgnkgtttatcaaatgataactggaagctgaggagaatatgcctcaaaaagagtagctycttggatacttcagactctggktacagattgkcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaaaaaaaaaaaaaaaaaaaaaaaaaaaa

SEQ ID NO: 2303 - DNA, 1471 bp, Homo sapiens
ggcacgagcttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggaaaaaaaaaaaaaaaaaaaaaaaaaaaaaaaaaaaaa

SEQ ID NO: 2304 - DNA, 1117 bp, Homo sapiens
gggtgtgtggctcagacacttgtgtcctcacctgccacagtgggaatgctttgtgcgggaaatccagaagttgcaacaggaagacaagtgccagaagaacaagctggacagctacttttgggaaaatggattcaggagggaggagacatgatagcaaacccacgtatgtgtttgacactttgagctatgtgcatgcttcatcttgataaagataaaacctttaaaaaaatcacttaagtagtatagaaagtataaaataaagtttatcagctattatactaaataatactgaatgcaagctctatattttactaagtgtaaatgggctgaatttgactgttaaagaacagtttatcagattggattattcaacctgtatttatcatttttgctacaagcatctattgccctttcttctagtaaagtacctgatttggatttgcggatttccccggttagatgagattggcagaactgctcatcaaagttcacggctctccaagaaactgacatgtgactctaagctatgccattaggacgtctgcttcctagacttttattcttcctcatagtgacatacagactgggagtactcgggactgagtcatcccagctattacaatatgaggaaactgtccatctgttctgccacctggacctcttcgctacccatttgctctactttctttactggaaaattttcctactggttctatcttacgaattccttttctgttttaactagtgagtctatttcagttgcctatagccaatgaactctaactgatacagttgaaacctccaataagattcagctggataagagaaaaagaaagattaaaatgaaaggtgtgtgtataaatgtatgtaagtaagcaagcaagataggtaaaaacaaaaagaaagcagaacttaaaatccacaaaacagaatttaagttgaaaggcattagaaacaaacagggtcattatgaaatgataaaatatatgattcataaggaagatgtaacagtctaggatgaaaaacaaaaacaaaaacaaaaaaaccctagcaaacagaacctcccagtctcagcagtcaaatacaattgcataaaaaaaaaaaaaaaaaactcgag

SEQ ID NO: 2305 - DNA, 1121 bp, Homo sapiens
ggcacgagtgcaaattatatagccagctctgcctgccaccttaagcttattgcttgccctctagctcttccccccataagagttaccccataattgcaaagtagctctcaaagttccaggcatcaaatctgtgtttgaggcaggaaatagatggaagagttggtgatagcaagcttttcttttatggtcattacgtttatcaggagtttaaaagtctttccagaaacattcagccaacattgggccccatggacacttttagttgcaacaaagtatggaacaataagcatctggcatagaggaatagaaccttccaaaccaatatctcgcaaagaataccgtctaaggcagggattggccaactttgtctgtgaaagggccagataggctctggtggctatatatagtctctgttgcaatcattcaactttgctgctctagtgcgaatgcagacatagacaacatgtaaacaaatgggcctggctgtgttccagaaaaacttcttcataaaaattgtaagtgggtcagactaactgtgggctgtagtttgctgacccctgcttagaactttatttcgctttggttaccaaatggtagaccagggggatgatgataattaagtaggtgctatttattgaatgcctactgtgtattcgtcacctgaagctgaacacattgccatctctaaaacatatttgtattttcttatcaaggaagaaagcagtttgttgagaaggcaagtagcggaatctgccacaacacaaattaagacttgattaaaagagatacaaatgcatagatggaaagccttgctattgtaaagataccacttttctccaaattaatccacaaattccatgcaattccaatcaacatttctgtagtttttttatagaacttgagcagtggatctgctcagtggattttttatggaacacatacatgtaaaaagtaaaacatcaatacttttggtagaaatttaaacttgaagcaggacagagcttaaaaaataagacacaaaaaacgtaagcaaaaaaggaacattttgatgaatcggttttcattaaaatgaaaaactttcatagaataaaaaggctcattaaaaaaaaaaaaaaaaaaaa

SEQ ID NO: 2306 - DNA, 2322 bp, Homo sapiens
ctcgtgccgaattcggcacgagcggcacgagggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagttatggaggttttratgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagcacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataataaaaaaaaaaaaaaaaaaaaaaa

SEQ ID NO: 2307 - DNA, 1330 bp, Homo sapiens
gtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaagttgggcttgaagggcgcagatgcctgtgttcaaggaaggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgtaaaaaaaaaaaaaaaaaaac

SEQ ID NO: 2308 - DNA, 1100 bp, Homo sapiens
ggcacgagggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaaaaaaaaaaaaaaaaaaa

SEQ ID NO: 2309 - DNA, 1963 bp, Homo sapiens
  misc_feature (2)..(2): n equals a,t,g, or c
  misc_feature (15)..(15): n equals a,t,g, or c
  misc_feature (1871)..(1871): n equals a,t,g, or c
  misc_feature (1954)..(1954): n equals a,t,g, or c
gnaactctctatatngaatgctggtacgcctgcaggtaccggtccggaattcccgggtcgacccacgcgtccggatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataaccyggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaatnggtmaaaaaaaaaaaaaaaaaaaaaaaagggcggccgctctagaggatccaagcttacgtacgcgtgcatacgacatcatagngcgatccct

SEQ ID NO: 2310 - DNA, 960 bp, Homo sapiens
  misc_feature (928)..(928): n equals a,t,g, or c
  misc_feature (956)..(957): n equals a,t,g, or c
  misc_feature (959)..(959): n equals a,t,g, or c
ggcacgagctcactgcagcctcaacctcctgggcccccacaattttcccacctcagcctcccaagaagctgggagtacgggtgtgtgcaaccacacccaggtaagttttgttttttgtgtgtwtttttttgcatagaagaagtctcactatgttgccctagctggtctcgagctcccgagctctcaaactcctgccttgacttcccaaagcgctgggattataggcatgagccaccacacccagcctctaaacactttgcatgtgtttcctaaaaacaaggaattatgtgggaacataaccacagtaagacgrttaaaatcagaaaattcaccttcatacaatactattagctaacctcgcccggcctagccttgacatttttgaggagtcggttctgcagaatgtccytcagttkgggaacatctgttgsttttctcaggactagrttcagtttgtgcatttgtggcaggaataccccggaagtgatgctgtgctattcttagtgcatcatagcaggagacctatgatgtcagtgtgttactggggatgttaattttgatcattggttgagatggtgtccaccagctgtcttcacagcaaagttagtattttctctttgtaaaataagtattatgtagccgggcacagtggcttaggcctgtaattccagcactttgggaggccaaggcgggcagatcacctgaggtcaggagttggagaccaccttggccaacatagtgaaaccccatctctactaaaaaatacaaaaattagcatggcgtggtggctggtgcctgtagtcccagtgactcaggaggccgaggtgggaaactcatttgaacccaggaggcagaggttgcagtgagcagagatggtgccgttgcattccagccgggcgacaagagcgawactccttctcaaaaaatnaaatataataagtattaaaaaaaaaaannana

SEQ ID NO: 2311 - DNA, 1691 bp, Homo sapiens
  misc_feature (2)..(2): n equals a,t,g, or c
anccgccggtgcagcatgtactgccgtcgcgtgacaggcccagaggctttgggcaaagcgagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagagtgtgccgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttcsatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggccsgggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctaggactttcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtsccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtccttcaaaaaaaaaaaaaaaaaaaaaaaaaaaaa

SEQ ID NO: 2312 - DNA, 385 bp, Homo sapiens
attcggcacgagtaataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaataaaaaaaaaaaaaaaaaaactcgagggggggsccggtacccattgg

SEQ ID NO: 2313 - DNA, 1634 bp, Homo sapiens
  misc_feature (1215)..(1215): n equals a,t,g, or c
  misc_feature (1218)..(1218): n equals a,t,g, or c
  misc_feature (1223)..(1223): n equals a,t,g, or c
ttttttttttttttttttttttttttagcagaacaacatgcttttattttaccatcatgcataaaaaggaagacaaatatgccaatggtacacttccaatttgtcagagcaatttcacagtatttaagcaatttaggaaaaaagatatatcacttactaagttgttaccagggaaaattatcatgtaagacaatcaattaaaccatacttttgtagattatttttccatgaaggcaatttgacaagcctaacaaagaccaagttgttcaaactatgtttctaggaatatagtttaacagaaacaagaacaagttgaaaactgttatgactattcatatgtctctatattgtacaggcaagtaagactgttgttcttccaaatgttcccaattgaaatcaaaagaatatctgtacagctcaattttcacaataagtttagaatcagaaaaaaaaattttactaaatcctaatgaaataacaatcttcacataaattaggtcacaaaacaagtaagaaagcattcaaagttgcgctgtctttcttttaaagaaccccttgtctaggcaacatatttaacactttaaccccttcattctccctgaaaagtatttttccattcatcatcattggggagtaagtactccttcctcgagagctcttaacgacagcacagtcttcactctaggcccaatttttacctggcccatgcctctagccttttgttcagtttctcctgcttagggcacctttcatcccatctagatgtgtctctctttaactattctaggagttgataaaagggctaggaagtaggaagttgggaagaaggggaggggcgtaagagctctagcactctattttacaggccaacttctttgcctctgaaaatgacagagccaaaatgaaataaaaaccttgcttttacaaatgtttctgagctatcacttttttaagagaggattgggaggctaaggagggcggatcacgaggtcggggttcgagaccagcctggccagcatggtgaaaccccgtctctactaaaaatataaaaattagccgggcgtggcggcgcgcgcctgtagtcccagctactcgggaggctgaggcaggagaatcgcttgaacccgggaggtggaggttgcagtgagccgagatcgcgccaaagcactccaacctgggcgacagagcaagactccgtcctccgtctcaaaaaanaanttttnaaaaggaaaacagggagagagagggaccttggcaggagccaatgtagggcaggtagcaatagaaagtgactagaggtgaaggaagagcaatgaagtaccataaatcacacagaacaagtggctcactgcttttctcctctgagttcattaacgtccagtaactgtccacagggcatgtgcccatactgctcaatgcagagctgagtaggtggaacaggctcccaaagctagaaatccaagtgacagcaaccagttcagaggccctgggaataaacagggtccaagcagtgcagataaaggcagtacaatctacagtatcatttgcttggcttacaagtagtgtgaaggatgacctcgtagcatgtgatattccagaacagcatgaaggtcatatggaagtggactcgtggc

SEQ ID NO: 2314 - DNA, 889 bp, Homo sapiens
ggcaaggaggagggccgccgttgctggagttcagcttagggaaggaggactctgaggaggccccgagccgcggagctttcgggggaggcgcccgcgcagacgcgaggcccatagccaggaccaccacctagctgattcttgatgacattggtcgggaaaactcgcctttcacggcccggccaaggggcatttgggtgcttttgctgcccgtggctgtgctcagcgttgtgggaagcccctgggaggccgaatgtgcaggatcaccgaggggaaagtgagcttgacaggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcgtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcaaaaaaaaaaaaaaaaaactcgagggggggtcctggtacccaatggtcc

SEQ ID NO: 2315 - DNA, 1578 bp, Homo sapiens
  misc_feature (1071)..(1071): n equals a,t,g, or c
acgcgtccgggcacactctcctctgactcgggccctcgctgagctgtagagggaagggggaaagcctcccagactctctgtcaccatgtgctacggcagatgtgcacgatgcattggacattccctggtgtggctggccatcctctgcattgtggccaatatcttgctttactttcccaatggggaaacaaaatatgcctctgaaaaccatctcagccgcttcgtgtggttcttttccggcatcgtgggagggggcttgctggtgttcctgccagcatttgtgtttatcgggctggaaaaggacgactgttgcggctgctgtggccacgaagactgcggcaagagatgcgcgatgttttcttctgtcctgcctgctgcgatcggagtcgcgggatctggctactgtgtatcgtggcagccctgggcttggcggaaggaccactatgtcttaattcttcgggccagtggaactacacctttgccaacaccgatggacagtaccttctggatacctcctcatggtcccagtgcactgaacccacacatgttgttgaatggaatatctctctgttttctatccttttggccctcagtggaattgaattcatcttgtgtctcattcaagtaataaacggagtgatgggaggaatatttggttatcactgctctcgccaacagcgatatgactgctgaaagaaccaccccaagacagaaccacaaccttcctctatttcattgtaatttatatattctacttgtattaatttgtaaaactttgtaccactgtatcatactttacatattctacttttataaatgtgtataaagactggcatcttcatgtgatgtcaagcgtagcaaacaaaccttttttttaggactgtgaaaacaaatgaggtcatttattgactgaatgacggtcggtcctcagcgtactgaatgaactctggcctgagtaatgtttttgagaaacattataaggataaatatcatttttccatttctattgtatgtgcatttccatttctattgtatgtgcatggaagatgtcaagttacttttttttttttnttaagaccatgaaggagaaaatccaacaacttgaaaagatgtgggtttttttttttcactgtttatatggtgtttcccattcatatgcctgccaatctctgacaagaggccattaggaactgttccgagttttgcaagagacagatacttgcccagagcaggacggctggttgaaaatgcccgagctagaggaaggactcaacaatgttgtcaggagtcctgccagatcttacctttctctgacacgtggaaaactttttgtccttcaaagacaagtgccaaggctcacatcttgaaaaagaaaaaggcctggatactcggacaagaaaaaatgggaaacggaataaaacagttaatcaacatcatgggaaaatgggggagaaggaggaagggcaagaggaccgtgaggaaataaccccaaaacttgatggttgaaatccaacaaaataaagtatccattgaccatgtttaaaaaaaaaaaaaaaaaaaaaaaaaaaaaaaaaaaaa

SEQ ID NO: 2316 - DNA, 2082 bp, Homo sapiens
ccacgcgtccggcatttcagtaataatgtagaaaaatattattaaaaaaagaaaaaaaagttcagaaccacaaccacgaggagcctcactgtgaaagaggcgcataataaaactactaaccagcggaggttatgctattttgagaaaaacaattaacctggttccagagaaatgttttatgtaaataataaactaattgtggcttgtaaatgatttgtatgtgatcctgtccactaaaatcacttaacaattctacaataagcttctgcatcaaagcctgctgcttgctctgtgccgaaataacaccgaatggaatctcctcatctcttgcctgttagccatgtgtctgattcagggcatgtatcttattactcatttttgtacatgtactctcgtttggttttgtaacttgcaattttcaaaccaaagttttatagtcactttttctcttcctgtttcgctgtagtcactggtgttcctttcccccgcgccccccgactgtaactcagtctgtgggagagacgccccggaaaacgtcgtgtactgtatattacctggtcatagctgattttcgcctccacagttcggtttctaggagccaataaaacttccccttgcctcctcatctttccaaattgttctttgaatggaggcgtttgaactcatgaacagttgcttggggatttgtgaaaatcctatctaggtttccgtgtttacagttctttggcgcagcctcgggcccttcccaggtacttgtgcgatgattgtattcactgctggatccttgaaggttcaaaaaaaagtgccatttcattatttgatcatcaccaaattctctctgcaaatggacgtaatcagaacattgtaacttatctatttatagtgatgagattaagactggagtgccatcacctcgggtgatgaattagcttttgctgtgtgtgtgccttccaaatcatgccataactgtaatgttgaatcggacagagccctacgtgcccgagggcggggcctacctgcccgagcgcgagcccttcatcgttccggtggagcccgagcggacggcagacgagtacgaggactacggcgccgacgagcctggcgacgagcagcctccccacgggcgctggcggcgcgccctgccccgcggcgcccggcagtgaacctgagaccgcgcaccgggcggccactctggggggaggtgttgggattttcatttacaggtcagacagagcagtgtacgtcttatctgcgatgtttcttccggcgttgcttcatccaagagtacgctttctgactgtagagaaccttgtgtctgcaggaaacctagctcgctgcacgcagtcttgtagacatttttgcctttgcccttgaaatgcttgcaaaatactttgctcgcgaaagctgcaaggagagaacgtgccttgtgacttcagttagcacaaagggcagcctcagtgaaactcttaggttaagcagtaagtcctggaacccagaactactgtatatttccagagggcagttcatcttttccaatacttgtttgcaattcagttacaccacgattaaagtaattcccctcctcaaaccaaaaaggaggaaaaaaacaactccattgcgattatttatcttcctcttctatcttctgttatgcattagggcatagaatgctcttatacacctcctttaacaaacacaaaccttaagccatgtagctgaaattactgtatcaactggatacagttccatattggcttaaacctccttggtttagacacactaacatttatgccaaattgcagaatattctgcagagatggaattgcatgtttgggttgtatatttagtatgaactatttttttttcagaacataatgtttcttagttatcaaaagcagttggaaaatgtttgcaagactatgaacatagaattgctgcttttatattttaactgcagattgtgaatttcactgccttatattatttatttctgaaacaaaagaggcatttttcaataaaactactgaaaatttgaaaaaaaaaaaaaaaaaaaaaaaaaaaaaaaaaaaaaaaaaaaaaaaa

SEQ ID NO: 2317 - DNA, 1671 bp, Homo sapiens
ggttttcaaaaacgtatttaggtgacactatagaaggtacgcctgcaggtaccggtccggaattcccgggtcgacccacgcgtccggatggcttccccttctaggctcccctcttactggtattcacgatgtcagggttgtgtgagagcagacgtgaggtgttccagatcatgcatatggacgtagaattgcttcggttattggaattatggatggctgtattatttcgttagcgtgggctgtcagaaatctgccaaatttaagagtaaaaaagaaaaagaaaagtcaaaatagagaggtgaggggaggaaaaccacttccttactggtattcgtaatcttccatctagtttttgatcaaaaagtgctcatttatttgtaaaaatccagacgtggtacctgaagcatagaatgttgtctttccaacacattcctcatcgttgtttccccagaaaatcgttttaagagcttatcaaagcagactaggtatccatattcagtttgacctaaatttttaaaataaacatttaaactccagtttttgtgtgtttactgtgcatcagcactcatgcaaatccgggatcagaaagaaactggggtttagccatctccgaatttccctttgcacatggggtacagtgggtttcaatatgcacttgctgcagagtttttgagcaccttatgggagtaagtagtgtttatttattataattaaaaagaaagttaaagctgcatctctgtagaatatttactttgcagagtgtaaagctgtagtatcttttccagcaggatttactctttcattcttaattcttggttgagaaaatcttcagtgatttaacattcctttatatcctcttaacagtgtcaaatctggggtagaagggaaattttttcccaaaaagggctccatctttgttacctttctgatcactcttagaaatctagctatgatcagtagatggtaacagctcatggcttcctgtatcagcactggagaggttggttgtgaggattaaaatctactcttttccctcagtgacatgtaattgctatgtttttggtaagaaagtctggtcagaaaaaatgtgaaagatcactcaaaaccaaagccagttataaggagtactgtctcctgttggtttaccttcacctcagaactacaagaatattacagtacctagtgaatagtctaacatttctaccagtcttttcagtagcctattggtcttggcatttcttggcactatgctctctgttcttggtgatgtcttcttgtttgtgactttttgttgttttttttttaaagtaactaaatgggactataaatgtagatgtgtatcagtaccaataagtttttttctgaaatccctgaattcccgattcctattcaagtcttttaaacttgttattttcttgctaagtagcaaagaacttttatttttcactttcctatatacctaagtatacctaaaaagtacggacactgcgtttcaatggactgtattgcgtgtagttttttgctgaaaactttttctgtaaacacaatggccttgttcagttttgttgtaaactgacttaccataagatgcactgttgatatgctttctgatgtgtgtttcataagggtgataaaataaagcttaaaaataaaaaaaaaaaaaaaaaaaaa

SEQ ID NO: 2318 - DNA, 1142 bp, Homo sapiens
ccacgcgtccggtcgggtctacgtgggcaatgtggcctggatgcacgtgctggcggcccgggagctggagcagcgggcggctctcatgggcggtcaggtgtacttctgctacgacgactcgccctataagagctacgaggacttcaacatggagttcctgggcccctgcgggctgcgcctcgtggagtcccgcctgctggtgccctactggctgctggtgcttctggccgctctcaacgccctgctgcagtggctgctgcggcccctgtttctctacgcccccctgctcaacccctacacactggccgtggccagcacgaccttcaccgtgagcaccgacaaggcgcacgccacttcggctacgtacccctgttctcttgggaggacagccggacccgcaccatccgctgggtgcaggccgtggagggctcagcccggtgacgtggagctggggcctggagcccggtgcgtggcacgtccgtccatccaggtccagggccctctagccctcggggcagaggggctggtgctacaccagctcgcctgccttgcagctccccgtgcttctaagccacgagccgcgagtctgcatcctcacgcctcttaagtcctggggcagggttttgggacaggcacatcttcactctcgacccaggccgacggctggctggggagtgtccgatggcccgattgttctcaactgccctgtcccatctggcttttcaagcaggaagtgagaaggggtcccacgggcttcgtgcaggccttctgaggtctgggcatggattcaggcctggattcggcctgaagatcctttctgactcctcctaccacctggggccctcttggagggtcatagtctcattttttcaggcctggattcggcctgaagatcctttctgactcctcctaccacctggggccctcttggagggtcatagtctcatttttttaaaaaacatttatcgccttttgacagctctctgctcttcaatgacgcctgagcaaacctgcagctttttccttcttcccacctctccacccaaatcacttcctacagtattgtgctgtacccagccgagccctggattaaagctcctaatccaaccctgaaaaaaaaaaaaaaaaaaaaaaaaaaaaaa

SEQ ID NO: 2319 - DNA, 900 bp, Homo sapiens
acgcgtccggtcatttgaggataatggataaaaaatataagggcattccatttagaagacacaaaataaaatctcttaatgtttttaaagataaaaattgatatgacttttttgatcaccatatttaggcaatacttacaatggagctgtgctcctttacttttgcctgtccttccccaaaaagggacaagttcaggagatagtacccaaaatttgtttattttaagtgaggaaagtatcattggaatatgtgtttatcctgatgttgaatcatatttaaaatgcactagagagatacctatctgaaacatatcatttaatgaattcccttagaaagcaattatccattattttattttctgttacaatttcaatttccacaaaggcttttaaactatgggtttaattgtattgattaccccctatagctagaagcagaagaaattaattagggctaccctattagctaacttagtatgctccatgttcagttctgtctttgacccattcttttgatctataaatatttttaaactcttcctgaccaacacaaacaatgctattttaaagtgaatggatattagccaaaatgtgcttgactggttggtaatgcttttgtgattttgtatatgtctccggttgcttctggggctgtgtggtcatgggtgttgaggtttactatttccaaacatcataaataccttgtattgccagtagacaattgaatgttgcatgttgcccaaagggattccatgtttaaagaacacacattattaataaagtaccttagaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2320 - DNA, 1326 bp, Homo sapiens
tcgacccacgcgtccgctcaattttttaagttagatttttcacagagtttgctattagtaaggcagctctctaaatgcaactgtgggttttcccattttgttctcttttacatcattaggtgtgagttccttagcttccccttgtaggaacaagagtaatgaaaggtcaccagagtgtgttttgggattttttttttttctttgtttttggagggcgggagaaggagacaaggcaaaagagaaattgtcgaatgaggaaggaaaggggggaaaaatcttcaagacgaaatttaaaataagccactgagacttaggtctctcagacatagccatatgaactccattctcggtgaattctgttcgggtttatttttcacatatccttttcttcctttaagaaatttttggtcctccaaaggattttgaagcatgtatattataaggtttagcatatttgttcatttgtctctgaagggtgtggtcagttcagagcagtttattttggacatatcctgaagcctttgttttgaactcagaaatgcaattgcaggaattggtaaaccattggtccaccagctttcctagactgctgaagaaggacttgattctctacgtgcagtcctaagtcctttaatgacactcttatgacaaatgtaaagatttactgtacacgtgataaattttattaagagtgcctcaagccaaaatgaaagtaaacttggccatatgtgaagaatgttgaaatgtactattgtgcattcctgtgctactgttgtgtttcaggtgtcacttagcttctgtaactgagatttctcaaaatgtgtcgaccgctttgcttttcttaaaatcttaagattccggatccaccatggttttgtttagtttcttattgtctacaaaacttaaaatgaaaataactgtttttagaatactagtggcagtcattgacttaaccatttacctgttgaagacctcatgcctagtagtggggtgtggtctggtttcccccagctacaggacaaccagtattcctaaatttataccctttattgaaatttgctcctgactgtcagaagtcaggccatctgatttatagaggattccaaaacaagagtttttgaaaaggcttattttatacacctatattatatggagaaacaaatgtttttattaaatgtttcgctgaccaaaataattttaaagaaattaacgttacttatatctttcaggaaaaataattgtagcagctgatctgtaaatgactttagaagctattttagtaatttaaataaatttactttcttggtttgtaaaaaaaaaaaaaaa

SEQ ID NO: 2321 - DNA, 621 bp, Homo sapiens
  misc_feature (364)..(364): n equals a,t,g, or c
  misc_feature (370)..(370): n equals a,t,g, or c
  misc_feature (426)..(426): n equals a,t,g, or c
gcgcccctagccacagatccgaggacaggcaagaccggcccagaagccacaccctcggctgaacccagtaaaagcacaacgctctccaaaaggcagtctccaggcaaaggcggcaggccagaccctaccctcgggacgactggttccagtgaggacaaccccttctcctatgatgaatacactctccggaagcgggggctgctggtcgcactgtgctkttcatcactggcattgtcatcctcacgagtggcaagtgtaggcggttaccccaattatgccggaatcgtaacaggtgagaccattggaaktaagggccggcaactgaattgatgggcaccccaagactgagtccccaccggctcancgtgcncagccacctccctccccttcgcgaagcctgcagaatagtcaataaagcccagcctnagagggaagacccgcatggagacagagctggggctgatggcccaaggcccctcccctccccaccctgcccacccagaggactgcccagctccctgggcactgctccccaagttacccattgttttcagatgaaaagtaaagcactgtggtccttgaaaaaaaaaaaaaaaaaaaaaaaaaaaaaagggcggccgc

SEQ ID NO: 2322 - DNA, 2144 bp, Homo sapiens
gggtcgacccacgcgtccgagcagatcaacagtacttttccatcttgctgccccaatctccccagcaggccacaggcaatgtgaaatatccctctagccaaccgacatttcctgactgccagtgttgcccttttcagcaaatgccaattccaagttccattgaatcagaactccatggctccttgacacatgctgttgagtgctgactgtgtgttctactgaaggagtaaaacactgactatccaaagagaaaaggatattttgttttataatgatcatatattattgtktattgtkttcttcttcccytttctatgcaactgtraaattaatgaacagagtggtatttggaaatggtaatacatttgtcactgatttgtatactgtatacagcattgggaaaatgggtgggggctttctaatatgataccttctttttaataaccatgacaaaaattgcataagaatgagaaaacaatgttacatttttacattccttcatattaaccttgtacaataacttcatttattttttccactcctttaccattaagttttggttatttataatttatcagccacatgaccaaatggatttccttgtgtctgtttccatgatttggccaaattactaaattcatgtatttcaatcaaatatttatgtgtatgatttaggccacatctctgtgtatgccgctgaacttcatttaagcatcatatacttcatttctttagtgaccacttggataaccacagtaaaagccctgtggggcctccctggcatttccattgggatttgtttcctgcattttatgtccctgccctatgtaagtaggtcttgatttcttaatttatttcatgtcccagtctatatgatagaggaaactcaaagcaggattctaataatctcaaagatcatttcaccaaaggttacccatttacataatcattttcattttgacatagaagcaaaacatgggataactttttttttcattgcaaagtcttgaktttcatcattaaacacacagcagacctttccttcattgtgctaccaggacatatctttgtcttcaattccctttgaagagaactttatttttgtttwcatatactcaagtcatttgtaattcttgaaattcccagtcattttctttctgacagcagacacaaatttaatgcatatttcattttacctttcgggtgaatgattacatttttttattacttttcatttgatcaatttatttggaagggatgtttatcaaaaacctatgtcmctgcttccacagaggaatgaaattaatmcttagatggtggtacccctgcctgtacctttgagtacattcacttaggtgttttgttcaacttctgatttaacctttaattgattcagttgaaacatgttatgtaatcaccaaatgtagagaaaccaaaacaaacaaacagtgaaaataatgtgttttgattcagcatacatacatttaaaacatcaggacattttaactttgggttctcttgacctgggatttggccagaaggaggcttaaagktagaaattgctattcttttagaataggttgggtgggttggggggcaagggtgtctatttgcagcctagatattttgagaagaaaattgttttatataagaggaaagccatgaccacctttctacctcagatccatcttcatccattgtgtttgaaatagctttatgctgctgcagtccgcaaaatctagagctttttcagaccacatcaaacccaagaaaatcacctatttaaagaaaaaaaaatttccctgaactctgaactacmagttgtagatttggtgtcttccttgktctttctttgaaaaaatacgtattcatttttttctgcttgtaattgtgtgcaacatgtcttctctctgctattaaagaaaagctacagaaarcactrcattgtaamcttctaagtaataataaaaaagaaatatatcacaataacaacaaggggaaataagtatgtagttcttttgaaatatgtggtaaagaactaatcatagactatcatctaatctggttacatgttgtatttttcatcctgaataaaagtaattttaacacaaaaaaaaaaaaaaaaaaaaaaaaagggcggccgc

SEQ ID NO: 2323 - DNA, 1187 bp, Homo sapiens
  misc_feature (1076)..(1076): n equals a,t,g, or c
  misc_feature (1124)..(1124): n equals a,t,g, or c
cccacgcgtccggagaaatggcatccggcttggggagactgcttttgcgggggcctcgctgcctcctgtcaccggccactcccactctcgtcccgccagttcggggcatgaagaagggattccgtgccgccttccgcttccagaaggagttagagcgatggcgcctgcttcggtgcccgccgccgcccgtgcgccgttcagagaagcccaactgggattaccatgctgaaatacaagcatttggacatcggttacaagaaaccttttctttagatcttctcaaaactgcatttgttaatacctgctatattaaaagtgaggaggcaaacgcaaaaccttggaatagagaaagaagctgttcttctgaatcttaaagacaatgaagaactcgctgaacaagggacgtctttttcaaaaacttgcctcacacagtttcttgaggatgcatatccagacttgcccactgaaggcattaaaagtcttgttgactttctcaccagtgaggaagtggtatgtcacgtggccagaaacttggctgtggagcagttaacactgagtgcagaatttccagttcccccacctgttttacagaagactttctttgcagtgattggagccctgctacagagcagtggccctgagagaactgctcttttcatcagggacttcctaattcctcagatgactggaaaagaactttttgaaatttggaagataataaatcccatggggctactggtagaagaactgaagaaaaggaatatttcacctcccgaatctagacttaccaggcagtctggaagtaccacagctttgccagtgttttttgttggcttatactgtgataaaaagttgattgcagaaggacctggggaaacagtgctggttgcagaagaagaagcggctcgagtggcacttaggaaactctatgggttcactgagaacagacggccctgggactattccaagcccaaagagaatttaagagtagaaaagacttcactgccagctaacctgtcaaaatagtggcaacctggaattttttgagccagagaatgagataaatgttgaaaatnttcgaagctggatatatttccaaattgtaaataaataggtcttatttntcataaaaaaaaaaaaaaaaaaaaaaaaaaaaaaaaaaacaaaaaaaaaaaaaaaaaaaaaaa

SEQ ID NO: 2324 - DNA, 1233 bp, Homo sapiens
ccacgcgtccgcctggtttccccctggctgacagtgccttggttcctgtcctgttggaatgttaccattgggcctcctgacagcatctgggtgacgccgggagaagcctccctcatcatcaggttctcctctcccttcgacgtccctcccaacctgggctatttccagtactatgtccattactgggaaaaggcgggaatccaaaaggttaaaggtcctttcaagagcaactccatcgtgttggatggcttgagacccttaagagaatactgtttacaagtgaaggcgcatctctttcgcacatcctgcaacacctctaggcccggccgcttaagcaacataacttgctacgaaacaatgatggatgccactacgaagctttcaacaagtcatcctcatcgccgtgggagtctttctgtcgctggcggcgctggcggggggctgttacttcctggtgctgagatacaaaggctggtgaaatactggtttcactctccgccaagcatcccatcacaaatcgaagagtatctgaaggacccgagccagcctatcctagaggccctggacaaggacacgtcaccaacagatgatgcctgggacttggtgtctgttgttgcatttccagcaaaggagcaagaagatgttccccaaagcactttgacccaaaactctggtgcggtctgctagcctgtggggtaagggctctgagccgaggaagctgctgatgtccatgtcagcactttatggaatccggtcctccattttcctgtccccaaaaggccgtcagtgcctgtgaagatgtaacgggtctcatgggggcgacaagcttattgatttttttcttcaaactaagagttttctaatcatacgcgtttttagaataattctacagatatgtccccgaaagattaagatttctcttaaacactaaaaagacatgtaattatttgttagcaaatgggcgtctggcacgcctctgacactttctcgtcagcagccaggacacgaagtcccctccttgatgaacccctcgggcagaccatgtcacctgtcccagcctgccccaagaagggacattaagtggcccttcttcatatccaaacacctggcttgaaatgtgattagccctgtaaatagtttcacagagattaagcctttttttcccccaagttaggaataaaagactataattaactttttaaaaaaaaaaaaaaaaaaaaaaaaaaaaaaaaa

SEQ ID NO: 2325 - DNA, 1197 bp, Homo sapiens
  misc_feature (1182)..(1182): n equals a,t,g, or c
tcgacccacgcgtccgctttcatctgagtcaaatagtatgaaagtgattgagttaaaaactgaaaaacctggggcacctgggtggctcagtgggttaaaccactgccttcggctcaggtcatgatcccagggtcttggaatcaagtcccacatggggctctctgctcagcagggagcctgcttcctcctctctctctgcctgcctctctgcctacttgtgatctctctctgtcaaataaataaattctttaaaaataaaaactgaaaaacctgataaatacttagtatgttaagcaaatttatgaatcgatttagcacatttgcatgtaaatttcccttgagttacccttctctattttatgagcccttgaaaaataatccttaagtttttaaatttattgaaggctccaaactcccagcactagctagatattacaaatatgaaacaaactgatttcaaaatgaccaagatttgggggatctgataactcagccgttttcagaaacaactggagagtgaagagatctctctcacttttgcaaacatgcctgactactcacaactggcttttagcactggctttgttgaatgcacaaagcattcactttactgattggacatgaatgcttcaatatttctgtgtattcatatatctgctcagaaaataaaacatatgctttggtatttgttttttgcaactgagattgtggaggatattcaccctcagtttgatttcttcatcttttgggacatgaaagactactctgccagctctttaaaaaacaggtttgaattaattattttcaataatatataagcaaacaaaatccccttggcagcaattcacattgcattagaatttgagtgatactttggcatttctgctttctcttcttttccggataattgcacagttctcttgctctctctaaactggatgtgtaatgtcttctttcttttgaaaagtccttgagtatcattaatgtgataaaccaagttgtatagcagtaacaaaaacttgtgatactatgagtcttttgcaatgttacctcagctaaaagaggtatctgtgtgtgtgtgtgtgtgtttaagttgtttttgtctagtgtttcaaatgttttcagcaaattgtgtaatatgaaaagtttcaataaaatgttgaaataaaaaaaaaaaaaaanaaaaagggcggccgc

SEQ ID NO: 2326 - DNA, 5077 bp, Homo sapiens
  misc_feature (5055)..(5055): n equals a,t,g, or c
  misc_feature (5071)..(5071): n equals a,t,g, or c
cgagaacaattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcytccggaytctagcctaggccscgggacggataacaatttcacacaggaaacagctatgaccactaggcttttgcaaaaagctatttaggtgacactatagaaggtacgcctgcaggtaccggtccggaattcccgggtcgacccacgcgtccgagccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacatygtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaataccaaaaaaaaaaaaaaagggcggccgctctagaggatccctcgaggggcccaagcttacgcgtgcatgcgacgtcatagctctctccctatagtgagtcgtattataagctaggcactggccgtcgttttacaacgtcgtgactgggagatctgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtanaggtttttttttttanaaaccc

SEQ ID NO: 2327 - DNA, 1634 bp, Homo sapiens
  misc_feature (1056)..(1056): n equals a,t,g, or c
gctcaaaactaatgtttatgccatgtactttccctcagatgtgacttcattaattcagccatgtgaccagggtatctttagatcaatgaacagaaaatataaatccactttcttgaacagcatgctggcagcagtgaacagaggcatgggtgcagaaaattttcaaaaggagtttagtataaagaatgccatatatgttgttgccaatacttggaacacagtgacaaagacacagttgtgcatgtctggcacaacctctggcctgcaactgtgtttagtgataatgatgaactgtgtgtgtgtgactttgaaggattctgtatgtcaagtgaaaaaaaatgatgtctgacctccttacatatgtaaaaaatataccttcagagttcagcagtaagctggaagaagtagatgtcaaagaagttttgaactytgataataatgcttcagttattcattcattgactggtggtaaaatagtcgawwtggttttgaatcagggttatgatagtgatgaagaaggtcaagataacaccacagaaaaggtgcttatagaagaagacatggtgaaaatgtatggtgggcatattgaaggattacggcagcgtgcattaacaacagaatgaaaaaccatgtcagtttttaaaattgaagagagacttctgagctaaaaaccatgttaatgaggcagatgactccacaagaaccatttttaaaagccttccagcagaatgtctcttcatcccccgtaggatccacttcctggtccctcagctgcttctgatgtttcttcttaactaaaaaacacagtttatagtaacctttgaataaaaacacagcatcataggtgaagactgaaagcctgctgttgtttgtagctgctttttcctttttttttttttgagacgtagtttcactcttgttgcccaggctggagtgcaatggcgtgatctcggctcactgcaacctccgcctcctgggttcaagcagttctcctgcctcagcctcccgagtagctgggattacaggcgaccaccaccacgcctggctaatttttgnatatttgatagagacggggtttcaccatgttgaccaggctggtcttgatcttctggccttaggtgatccacttgccttggcctcccaaagtgctgggattgcaggcatgagccactacccccggctctgtggttggttttgtttaatagctgaaacaggtatcctggtgatgctactatgctgcttagttgtcctgacacattattttttcagtgttaatggtatgtcatatttttactgttaagtacttaatgtatgaataaatgtaagaaaacaattgcctattgttagcatgtagattaagagtcaggaatgatgactcttgttgacatgggtggctgagatagtgacacctttgctttctgatggttcagggtacacaaactttattacaggcacaaaattatcaaaaatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaaaaaaaaaagggcggccgc

SEQ ID NO: 2328 - DNA, 1648 bp, Homo sapiens
ggcgggagctcaggaccggcgccttctccttgcttctgggggtcgtggccttgctcccgctgtgcggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaagaaaaaaaaaaaaaaaaaaaaaaagggcggccgc

SEQ ID NO: 2329 - DNA, 1726 bp, Homo sapiens
ccacgcgtccggaccatttaaatgaggctccattcaacacaatgcacatttaaatgaggctcagttgcaagagaccactgggcttagcgttttcaatttgtcaactataattctataattgcttttagctaatcatccaaatgattacatgttgtaatggaggcagaagaccctcgtatgcatcatttggtctctttttctcagaggaagtgctgaaggatcaaatgttttgtgtgtctctgtgtgtgtgtgtgtgtgtgtgtgtccgtgttttaacttggtgttctgacgcacaacaccataatagacctccattttcatcaacggtgggggaatgagaacaacgccccccatcccaacatcccccttttccagagggggaaactgagacccaagtttccctcttgccaaggccacaggactagaactagaatcgtcagttttctgatttccagatcaggactatttctgcttatgccattttaatttttcatttctttccataaaattaaatgaccttcttcaagaaagatttaatggtcaagatgcgatttggtaaaaagcttcctcaaggatttttttcttattacaaagatgagaccggctgaggctgagagatttgcaagcagtggtatgtcattatccccagctcagttttttgtgtaattggtgtgaagagattgctgctgatgaatcagcctgctgctcaacagaaaataatgattcttttgtgacgtgagtcagtgtacgtacgtgtacgtttgtggttgtttatgaaaggtatgtgtgtacataaaatgcttatcaagatggataatgtcattttaaagtggtaaataataaaaaatagtcctgagcaaaactgattttacaattgcctgagaatgcagcacttcattttaacactatgcaatggctagaaattgatttttttttttttaatccaattaagcctcaaggttggttatccatttaaaaggtcggatgagttaaacaatgacagtaccttcagttcgtgctaataaatttgcacagaacttcagcacttacatcgtgtgcctcacagaggcatacattttgtatgtgcacaacactgaactaccaaagtcccagcagtggtacagatacaccagcagaccctggaccccaactgggggagtccctgagctgaccgccggccctatcacctcttccacttagatccccgaagcacccccaccccagagtgctgagtccttccatctacctggcccccttttctgtggccccaagagcactgggagatgaaaagttgcctctcatttaaaaggggggaaaaagatgtattcactacttggttttgtgtgctgctgagtttataatgtaacaaataaatcctgttttaaaaatagtactttatagtgtgtatttactgtgtattcatagtgcattaagaaaaagacttcggccgggcacggtggctcatgcctgtaatcccagcactttgggaggcagaggcaggcggatcgcgaggtcgggagatcgagaccatcctggctaacgtggtgaaaccctgtctctactaaaaatacaaaaaattagccaggcgtggtggcgggcgcctgtagtcccagctactagggaggctgaggcgggagaatggcgtgggccagggaggtggagattgcaacactgcactccagcctgggcgacagagccagactccgtctccaaaaaaaaaaaaaaa

SEQ ID NO: 2330 - DNA, 1175 bp, Homo sapiens
  misc_feature (740)..(740): n equals a,t,g, or c
tcgacccacgcgtccgcccacgcgtccggcctccacagtttcctgcggctgtctgcacacccagaccagagcagttcctgcctttgcgctttgcaccattttccttggtgaacttctattcatccttcaaagcccagcagtaatcatcctttagaaagtcttctttcagagggaaccaaaaaggtaatcgctggagacagacagatgctgcctgaatgcctgttgtgttgtgtggttgtgggaatgttacttcacctctccgtgcctcagtttcctcagctgtaatggggatggtaacagtgtctaggggtactgcttggaatgcacatagggagatgagtgaaggcccagcactagaagagtgcaggcactagcagagtgcaggcgcaattgctgctgggaccagcaggtaactcgcatccaagttacagtgcccagccccagcagcagcctcagcaccaggcagagtgtgctcagcamtgtggggggccaagaggacttgagggccgctggtctgtgattctctcatctcttttgaggttmarsamttggcgtctctcctagaagctctggggaamctgacaaatcctccagggaggacacagaacgccaggaagggctggctcggggtgcaccaagatggctgccccgagamaccgtatctgagggcttgggtggaactgaggagaggccggctgggaagsccatccgggaggaaarggcagacggctamggcagcntcaggtggtacagtttgccccggaagtgaggtagagaagagagcgggaggagagagggccacatgcctctcagccatggccctgaatgctggcttggctgagcctcatctttgctgtttgcagaatggggagaattgtgcctgcccagcctcctccttggggactccaggggcccaaagaaccaagagctgcaaatgtcctggtggccttggaagtttatggatggtacagatctggggtggagggcatggccaggacagggagggctgtcagagagagggtctgtgggtttgtggagtgtggggatcagtcgctgactcattagatgaaccaggagcctgcatgctacagcccacctgccaaatcttgcccccacctgctttttaaaataaagttttattggaacatgaaaaaaaaaaaaaaaagggcggccgc

SEQ ID NO: 2331 - DNA, 1014 bp, Homo sapiens
ccacgcgtccgggctgccccccaagtgtcgtttgttttactgtagggtctcccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgcaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttgatgggagagacaaaaagagggagagtgtgctttttgtacagtaataaaaaataagtattgggaagcaaaaaaaaaaaaaaaaaaaaaaaaaaaaaaaaaaaaaaaaaaaaaaaaaaaaaaa

SEQ ID NO: 2332 - DNA, 1827 bp, Homo sapiens
ggcacgagcargaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactsttccaagcctacaacttcaagttttatcatttgaactcaagtacttttgctgctgaggaatggaatcaaaagaacgtagtctcctggtraccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaaaaaaaaaaaaaaaaaaaaaaaaaaaaaaaaaaaaaatt

SEQ ID NO: 2333 - DNA, 734 bp, Homo sapiens
gatttcatttaggtttttgttaggatttccattaataattgtgataaaattttaacttgggttacagtttaaatatctggaaaattctttcacagaaagttacctcattcttcagtgatactggctaagtgaattataaccagttgcttgatggtatatgacatttttgcagcttatttgaatgtttttaagtttttaattatattgctttctattgtaggccttgaaccaaagacaatgattgatttaactgaatttagaaatagcaaacacttaaaacagcagcagtacagagctgaaaaccagattcttttgaaagaggcaagtgtggtagtcagttgattattttcttggctgaactatagagaaatactaataatttatactttgcagattgaaagtctagaggaagaacgacttgatctgaaaaaaaaaaattcgtcaaatggctcaagaaagaggaaaaagaagtgcaacttcaggtatactcagttattctaaacctttaaaaagaattattgataagtgagttgtctggatatgaaattatttgtgtcttagctgtttttgctgttctattgtggatctgctacaaatttaataaatgacaataataacctgaaggagataagtgagtgtcagtgggttcagtcctgaatctgaaatagacaaaaacaaaacaaaacaaaataacaaaaaccaagcaaacaaaaaaaaaaaaaaagggcggccgc

SEQ ID NO: 2334 - DNA, 1392 bp, Homo sapiens
acgcgtccgctctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatggaggagccccctgtgcgagaagaggaagaggaggagggagaggaggacgaggagagggacgaggttgggcccgagggggcgctgggcaagagccccttccagctgaccgccgaggacgtgtatgacatctcctacctgttggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagtgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttctaaaaaaaaaaaaaaaaaaaaaaaaaa

SEQ ID NO: 2335 - DNA, 959 bp, Homo sapiens
ccacgcgtccgcggacgcgtgggcggacgcgtgggcggacgcgtgggtgccgcggaaagtggaggtgagggccgcccgccctagaggtgcccgtccgaaaggcagagctgacaaggaaggtttcgaagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcaaaaaaaaaaaaaaaaaaaaaaaaaaaaaaaaaaaaaaaaaaaaaaa

SEQ ID NO: 2336 - DNA, 2263 bp, Homo sapiens
ctcaggtcttctaatttgaataatgttcttgggtttcggatgaatatctttgatctaccaaaggagtattcttccacgggaatttctaattcattaaataggacctccacaccagacctggctggtcctttccaatgaggccatgtttgtttacaaagcattttgtatctttctaggcaaggttcataggcctgcctgaaggcgtagcctgccctccgcactcggacgttctccaaaagccccaggtacctgatctgatgacacactagagcctcgttgaagatgtgtgctgcttttttatcattcggtttgatacacctaatatagtttgggttcttggtctgtaggtttttcatcagagtggccacggatgccttgaactgtgagcctgctgtaggaggccttttcaggttgatcttggcgggattcccttcggggaacaaagacttgatgagggcatggctggccttccacatggcttgggacaggtctcgatagagaaggtcattgtttttgtcaacgaatccttccacctggtacagcacctttccagcataatgctggatcctgaagcagctgtgaggcagagacgtgtcattgaggaaccgagagcacttgctcatcctgctttcaaaatgctggtgggtggcacatacttggttcagcttttctaagaaggtctcatcagtgactgtgccaggtctgaggcactcttcatccagcatggccaggattccatttgtgttattttctattaggtcacaaatgatagcattattgaagtagtcaatgtgagtccattctatatcctcccgtatatactcctcctgctcttctttaagagtaagttcaatgaagatttgttgcagcttttcgttacaataattaataatgaactgctcaaagctgttgtcctcgaaaatctcaaagccataaatgtccagaacacccatgaccttctttctcacttttgtttgtgccttaatgctttcattgattcgatttaccaaccatgaaaacaacctgctgtagaggtttttagccagagcatcacgggcataataagcctgagccacattcagtgtagttgaaactttctctgttggctcaactgttcggaaactgaatgctcgtctagaactgattgatcaatgccggcaattcacaaatttcttttaactcattttatctttgattttgctttcatctagaccattcactcgagattcgggcttgaactcaatgttccccagtttcaacactgctgccaccaccgccaagacagactcagcttcatgatccataaagcccacaatctgcatggcattccgcacggttctaaaatttgctgcatcatccactccattcactttggccgaatccagactcaggtagttatacctgctgaaatccctctcaagcttaagtttattgaggagctcttcagaggcaccagagagcagctgatagaacacatggaagtttctttcacctcttggctgtttaacaacccgagatttctctaaaagatagttacttattactcctcctagtggatcgcctttaaagtcaaattcaatatccatatatttgccaaatctagaggagttgtcattccttacagttttggcatttccaaaagcttccaggaccgggttggactgtaaaagctgttctttaacttgattaacttctgctccttttccacaaacagctgccacataggacatgacaagcttactggcctctgtttttcctgctccactttccccagtaatgagaatacattggtccttatcttgatctcgtagggatctgtatgcttcatccgaaagggcaaagatgtgagggctcagttcataaaaatttctgttcctgtattcttccactttctctggtgaataaatgggtaaagaccgatatgggttaacagatataaccacacttccaatgtaagtgtatatttcactgtggtcaaagcgcttcttgaggttgttgatgaaggtctcctcattgagaggttctaaaagaaccatatccccaactccaatcatattgtccagaagtgaggttttcacctccattttggccatggtctccaggtatatttcactgtggtcaaagcgcttcttgaggttgttgatgaaggtctcctcattgagaggttctaaaagaaccatatccccaactccaatcatattgtccagaagtgaggttttcacctccattttggccatggtctccagctcgcctggcggtcgac

SEQ ID NO: 2337 - DNA, 5083 bp, Homo sapiens
  misc_feature (5079)..(5080): n equals a,t,g, or c
ctcgagtttttttttttttttttttatggaattactgattttaatttttgctttattaaatgttctcatttttctatcatgagaatagattactatatccaacaaaagggagggacagaaagaaaagaattaacaaataatctcattgcaatcgctactgcatacctagaagctaactggtaatacacacttgcctaagaactaacaaatcaattcaacagacacttcaaaagaacccatgttacaaggcatcctatgcatgggacgaatgcaaagtcccacctacaatgtcacttatccccagattccccatctaatgaaaattttctatcttcccacagcacatgccttgcttctaacagacaattattgratgraaaaawtwaaagcaagtaccttagtamcatgaatcacaaaagcaatgtattctgaacctgaaaytgacaattacaaaacaaatgctatcctgggaaaagcatttcctagacaatacctggaggccaactggcattgctggatttacttccgattttatttgttggtggagatttggcaggtaaccagctatcaccagcaggacccgtatggccacccagtgtgtcaccagggatgatatcaaactggttgtacggtgaccctccccgggttttaccaggggccactatagcgccatttttgtgcatattggcttcctgtgtggctacagagggcagcccctccatcatggaggtccactgtttaaagcgagactcggttccagcctccttcccaccaaccatgccatagtccatgccgccagagctgaagccagaaccatatccaggtattggccctttggtttgaaggtctgggagccccacattcaatgcgttgggtaccatgttgtccagatgcggcttgggcccaacaggatgagagggcgagtgcttcatgcctggctgcctctgctgctgctgctgctgctgctgcagtgcactcaccattcgagccagctgctgctcttgctgttggcgtacagcttgagaaatctttctctggttctgtaacaactgctgctgttgctgctgctgcaagagaagctgacatgccaactgaaactggggaatttgtggaagctggctcagcatggcaatttgttgaggagataactggggccccacattgaaaagacctggactcaggccactgttgggaaactgcttgagcattgaggcagaaacctggggggaaataaactggggaggcacttgcgcccggagactgggagaagaatttagtggctgcacgggtgtgtgcagacctctcgattgtgctgtgctgtttccaaacaaaccatgactaccgcccttctyaaaataaggcccactatctgtggttcccatgtctttggaattaggtggacggaacccagatcgatccttcctcatgatatcattaaaatccccgagattcatcgctcgcttgtccacatcaaattttttatctgaaaggcttcctacagacaaatccattttgctgcttggattatcttcagtctgactcagcaatcccatatttgaaaactgtttggcaagaggattcatccatgaatcattgtttcctcctttgagtgagcacttcatttgtttctttcctccttgtccccagcttgctgagttgtgggaggaagcactgccctgagagccagtggtgttccagactcctccatcctcctcctcttcccagctgggatggcgagctcctgtgactggcccgtcactctccccccagccgtcttgcatagatttggaattaggcttcatggcattgggagcgttggcgggcgtgttcccccagcctgtggtcgatgctcctgtatcatccatctcgccccacccaggactgctttcatttggctcaccccaagcggaagtaccattatctggagcaggtggtgtgcttttgctccagactgatgccgatttactggtcattggggtgggcaggtttggttctcgaggtgctgggcccccttgggaattcttatcccacagattcacattcttgtagttataactgttagggtctccccatgctgaagtgccatcatcaatgtccattttccgactaattgactgtggggatggctcttcccaaccactgggttcctcatccttargtgttgcaggctgtggcccgctgctycagctggaattggaaggtcgaacgttgcctggaggtggtggkggtgggcctccccacgaaccagaagcctctggttgtggtggcggcggctgctgtgggggctgctgctgttggtgttgtttatyccaggaawtgggctgtcggcccgtctcattccatgctggggatcttttgcaatcctcccacccaccttttgaagctaggcttgcattgccaccattaccccaagtcccgatttcattctgccctccttcaccccacccagacacaggtttacttgcagaactttcccaattgctgttttttgtctgatcgacttcctccccccaaccattctttccagaagccatccttgattgggctggcgtccacctccccacccctgatccttgctgggattctcattccaagaggaaggtgtcttttcatcaggtcgtcctcctccccagttggaagagttgttgttcttgtagtcattccagcctcctgtgttcttggggtctttccactctgtagaggctgagagctccccccatccagacttcatttgattgctttggctgggtgcatctccccagccccctgagttcttggtctgtgtggcagcgctctcccacccctcagttcctttgtcagatttcccctcaggccttggcacctcttcaatgtcccacactgtgtcctgcttaatttgagtttggccccagccagtgtttgagagcaccctggggtccaaatcagttcggctcaaaagagtctgcaagacagcctgacaatcaggatgtgtgggcctgtacgaccgacggccagagttatgactgtcactacttcctgctwtgtggttgcttccagtgctttgacctccaacttcacttcctgtgragctggaagatcttccccaacagggagcctgggcattgccttggttttcagggagggggtggcccttttgattgtcccatgctccagtgctagaatttggttggtttggaccactccattctccaattttcaactcatcagacccagtcggctgtttccattctccctgagagaccccagatgtcattttgttcccttcaccccatttgttgtcattagagtcctgggggccaaagttccaggacccacccgtagacctgttattgttgtcccaagagtcattttttgacccagttgatttctgaacagaagctcctttccaggagtcctctctctcttttccattgttcccattgtttccagaattgctttgtccagagactgwgycagttccagaaggccccctagctgcaccccaagatccaacactcccagtctttcgatctccagtgctttgtgaaggggcatcagtgctcctggaggtgttccccaagcccattccaaagggcattcccttattctccatggggtttggtgaacttaagttcaaggagttagtgtttccattttttggtccatcagtgttatgaatttgagcctgttctctgccagagacaacaaaattaacacccgcattttccatctttgactgctgttccctggatgtctgacctactgtgctaacctgtgcactggaattactattatctgtttccaatgcccctttcctagaagttccttcttggaccagtgctggccaggcagatgggttgctatttgggttaaagttgctgaagccagagccaggtccaattctatcctgaccactcacattcctccaatttcctagtccattgttgttctctgtagtagagttggaagattgaacagatttagccttagggtcagatttccagaccccaagattacattcgttcccagaacttgcagactggcactggctcccttttcctttgttactagtggtgcttcctggcagagtgctcttctcagagccagggttcgaggcactgttgttatcggtggtgttttsggaagaarattcartgtytttgytggcaawacaargccaytyttcmatktcagacccgtytacaatcaccttktcccagatgtgaattgggttgggggaggtgccgttgttggaggaggytcccgagccccaagtggaatttgcataatttgaagcagcagcacctccaagggttgagtctggcgcagtcccactctcaytctgcagcagcgctcctgtcacttgtgcgttgtttgggtttgctccaggtgctgtgcagggaggaggccctgccccacccccaaggagcatgcaggacggtggagggggctgcccacgttttagtaacactttgtggtcctgctggcaacggaattgcggcggcacctcccgaggcatgtagcgggcggcgcttggcggttgtccgttcggcactgccacccttttggcattgttgccaccattgactggtggcgatggagagctgccaattgggctggcggccgttggttggcttaaacttggtttcgtcacttcgggcactttggttttttgttccgtgaccttctgagtggcttcttttttctttttatcctctttcttccttttcttgtcttccattaactgttcttccctttcttgctccttctctctcataaagtgcagcagtgcttaaatccagcaaattgaggcatacaaggtagaaatggaaatgaaaaaaggtccaaaaaatgaattctttttgtctatctgtttttttgtattttaaatattcagaaaccagcagagactctgtcggccattttggcttgaactaactctctctcacacactctccctcttgctctctcgtcgacgcggccgcgaattcccgggtcgacgagctcactagtcggcggccgctctagaggatccctcgaggggcccaagcttacgcgtgcatgcgacgtcatagctctctaccctatagtgggtcgtannaaa

SEQ ID NO: 2338 - DNA, 1790 bp, Homo sapiens
  misc_feature (639)..(639): n equals a,t,g, or c
  misc_feature (827)..(827): n equals a,t,g, or c
  misc_feature (852)..(852): n equals a,t,g, or c
  misc_feature (858)..(858): n equals a,t,g, or c
  misc_feature (886)..(886): n equals a,t,g, or c
ttggcggtaacaatgctctttatttgtggcgtttaaaggcggggttgggcgggacagcgcccttgcgtgtattaggcacaggttcggaacgcagcatctttccaggggcttccctactagctcagccccataaagtcactggtttcctccatctggaccagcagccgcaccagccaaggcgcccactgggtgtcggaggtgggcgatgtcaatccccgtggccttcgtcgggagggtggagctggccaaaaagagagcggtacagttctgtcctggcatcatcattcattgtagtatggtcaataggtgccatgaaactcagtagcttgctaaggacatgaaaccgaagtttcctgcctttgctggctttcctatctacttttttgtggattttgcttcgtaacttctggattgcaagccactgccttcccatggccacctgatcgttgggatccaaggagctggtcttccgttctatgagttctcgaaggagctggtggtaaaagtcatcatcatcaaagatttcttcatccaagtccttcagatgagcattagcaggggcttgaggaaggatctccggttcccctggcaaactctctgggacaggctgagctgctggctcaggtttgccaagaactngatagacggagcgcttggtctgtgtccttcgaagtaatctctctttgtccatcagaatatggtcgatctgagtcaagattgagcgttcaaaggcaccaaaacccttcccagttttcagaagccagttggtcttatcgtgccatttcttaagtgtccggttcctgtagactgaaaagtcggcaaagcgntttgccaatgaagttggaatagtcntccatntccagcttcctctttgcagggacctttnttggttgctgcttcttctcttctaccagctcatcatcttcactagaaatctcctcacttcccgcattgggctttgtcccatctactagatatctagtgtctgggtactggaaaagcaactcttcctgaagacctaccaatgacctcaacaatgctttaagtgccttgtgactatttttcagggcactggaaaattctgggccacctttgtccttgaacaatgggaaaacatctggttgaggaagctggttggtggtcaacagagctttttgtagtttgatccttccttccaagagctggtcccacagtgctatctggttcttcacggctcttcctttctccacttcctcagaaactttgacactagagaaggtcatcaccacaccatcatcctcactgtttctatctccagccctgtcttcctcactctcgccttgggagtcttccgcgtcatccccttcttccatgccactctcttcgtcttcctgtatggtgccagttgcttcttcatcaaagcaagcaaaggcatttctgatgacatcttcaggatctgtgccatttaacttctcaccaaacatggtgaggaacatggtgaaattgatggggcctggagcctcattcatcatggcatctagatactcatcagttggattcttccccaatgaagcaagcatatcatgcaaatcttccttgtcgatgaaaccatctctgttctgatcaatcatgttgaaggcctctttgaactcctgaatctgtgactggtcaaacatagcaaacacattggatgttgcacgctgagggcgcttcttggtcttggtctttgttcttttgctcgacatggtggtggttaagtcccggcacagctacgagaatccgagcacctctccgagcccctcggtcgacgc

SEQ ID NO: 2339 - DNA, 829 bp, Homo sapiens
  misc_feature (16)..(17): n equals a,t,g, or c
  misc_feature (25)..(25): n equals a,t,g, or c
ttatgaccaattaggnntttttgcnaaaaaagcttattttaggttaacacttatagaaaggttacgccttgcaaggtaacsggtccggwaattcgcggccgcgtcgactgtgtatgtgtgcatgcatgtgtatgtgtgcatgtgcgtgtatgtgtgcatgtgtgtgcatgcatgtgtgtgcatgtgcacatgtgtgtgtgaggaggggctgctttcctatggcacagtcactatgggggagcccaaagctgcagggtcagccctggggagccccctcattggaatcagaggaccacagctgtctgtaggtgaggctttctggggcctggatctgctctgcgcccctccggcattctgtgtgacagtggctctgccacagccctcctcagtagaagctctggcttcctggtggacctggaggccccgggagaccagggggaccctggatccctggttcacccttaggccccatggccccccgctggcctggtgaccctgtcttccctgcaattcccggttttccctgaggccctgagggccctggagaccccgggggcccttctggccctgggggccctatgtccccttttgggcctggctgtcctctcggccctccagttccaaagctgccctttgagcctttgaggcctgggaaccctcgagggccaacagggcccctttctcccacaggcccggcctctccaggttgcccctgaggaccctggggtcccagggggcccaagctgccggggtcgtcgacgcggccgcgaattcccgggtcgacgagctcactagtcggcggccgctctagaggatccctcgaggggcc

SEQ ID NO: 2340 - DNA, 2574 bp, Homo sapiens
atttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaagaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatyttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagraatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctrtttgcttttgttctccctctgtcttaggaaaagccatctttaatatagttcttcaccacygttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatayatccattcaaaattatgcaagttagtaattactcagggttaactaaattactttaatatgctgttgaayctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaaaaaaaaaaaaaaaaaactcgagggggggcccggtacccaatttttccaaaatgggcgag

SEQ ID NO: 2341 - DNA, 1579 bp, Homo sapiens
  misc_feature (1522)..(1522): n equals a,t,g, or c
  misc_feature (1537)..(1537): n equals a,t,g, or c
  misc_feature (1541)..(1541): n equals a,t,g, or c
  misc_feature (1563)..(1563): n equals a,t,g, or c
ttgaaggtacgcctgcaggtaccggtccggaattcgcggccgcgtcgaccacagacaggacgcakggttactagtattttggattgactgcagattttgaactgtctgcctagatgaactataccatgtccctagggccaagtcccatgtgcattttgtggctactagaccctcttcagaaatcaaacacaaaatagctctggcctgtaaagaaaacaaacttcaccagtaaaattgtttcctgttcctatccaccaatgtgcatagcacagtgtgtagtctgggtaatacggtttgcataattttttgataatgttctacttaaaaagggcagtgtatttatatattacttatgtaattaaaaaaaaaattcttctggctgggattacaggcgtgagctgccgcgcccagccgtgactgggctctttcacttagcgtggtgttttcagagttcatccagaagaggatgytatttaaaactagttttgcagatgctgttccttacggcatgactcttacctcttccatggtcattgggaagaaattccatctgggtgcagcgtgacgggaatgttttctgttttcttttagggtttgtcacatggaggatgtgtacatatggattctctaaattggatcgcgctatacatattttttttttttattttcttagctattctctattctagattatgytttgaattagcttttccagtttaatagaaaaatctttttgagatttttgatttcgggagaattgacagttttacagagcccaggaaaatggtgtttctccttgtttgttaagctcttcctgttcttcagtgaagtctcacggctttcttcgtgtcgtctgggctcattcttagtcctggagtgcttggctcttgcgttcttacattccatagcagtctgcagattcctatgaacagaagagcctctgaatctcagattaggctgtgtttcgatctgacaggaaagctggttccctgataaaaagtccagaaatgcccgctcagctcagctactcctgaggtcaccagggccttctgtgcactccacgctgctgtttttgctcaggtttttgcctcgaggtttcacagtggctgccagagctctgaacatcactgacacattcatggcaggcaccaggaagcctccggagaagggacctttgctttccatggatctgktggctgatccgcagcagcaagagccatgtctcccagaagactgctccctctgkctcatgagccagcctggctgctctgctacaggacactccttgtttttatgtctctctgtgtattccagtgggatttggggaaggagaggcatcgggtgcagggactcagtgtgccttcttgaaaccagaaacctctcacgctctctgggcctgtttccacttctgttgatgtggtttttactccgttgtatgccgttgctctgtcttcacacgggcagccacaccggtcgacgcggccgcgaattcccgggtcgacgagctcactagtcggcgacnactctagaggatccntcgnggggcccaagcttacgcgtgcnggcgggtgtccttaaa

SEQ ID NO: 2342 - DNA, 2202 bp, Homo sapiens
  misc_feature (255)..(255): n equals a,t,g, or c
  misc_feature (1084)..(1084): n equals a,t,g, or c
  misc_feature (1177)..(1177): n equals a,t,g, or c
ggcacgagcctgattccatgttcttggccatgttagccataatatcctgtgcagtatgtttttcctgtgcagaggcaaaaacatattgggcatatgttcccaagcccccagcagtatgacccatactttggagtgacactcctcctaagatttatcatgattaaggagcatgggctccaggacccctaactccacctgacatagaacagttagactctcagaataatgtcattaattataccgctccattggaangacttcctttgtgtgtcaccacaaagacatcactcagccatagctgtcttacagttcaagctcacacatggttgagtcactatgggaaaatcatgtacttattaagtcttggttatattaatgtaaccggtgtgctaaccaaccattcctggcccagtcgccttcattgtgctgactatacagaatggattcccttcaatagttcctacccccctccatagacccagtgtcttagcccactggctagaaaacawtctatgttaactggagacattgtggatkggggacctaaaggccaattagatggaaaagaagaaaatcagaaatcatggcacaaactttgctggcattggtggcaagcttttaatgcttcttctttatataacactgggatccaatcccagtcggccgcccagattgcttggcatggagcaggctttagcccgcctcttcctcagtggcattatctagggaggaaaggaccaattcaaaagatgatatggaaggcagcattcccatttatgaatggcaacatctgggttgtaatactatccaataatagcaatagtaagcaacacagtcttaatgttacatttgtaaagaatatcaccactcaatttacagtttgtgtttttaatccttatgtgtttttggcagctaagaaggaccagctccaggtaaacaatacccaattgacctgtaaatcttgccagttatatcactgcattaatcatagcacattgcaaacacataatatctctactttgatgattttaggttgcatccctgggctatggattcctgktaatctgtctgatccatgggctgncacaattgctttacattttgtgaaacttcttctaactcagtttactcattgkgtccgtagaggcttaggcatgataatttttgctattggttnacttggtcacactaataatttctgktgtgatgtcctctgtagctttgcatagttctattcaaacagctcagtatgtggagaactggacacgcacagtcaaccaagggtggctacttgagaataaaattaacactgagttacaaactgaagtggcagtgttataatccacgattctatggttaggggaacaagtacaaagcttgcaattgcagcagtaattgtgttgtcattttaatcacactcatatttgtgtaaccaacttagaatataaccaaagtgagtatccatgggatctcttgtgaaagcccatttgcagggagctttcacatccgacatcacctttgatattggtgaattacaaaacaaaattcttgatttaaataaacaaattccagagtttcagccttctttagaagactggactgaattccagcaaggcctggagagcgtcaacccttggacctatctaaagcaccacattaacatcttatatatagttcttggaataatgttgttttgtctctgtcttctgttcatagtctgtaaaatcggatggactgccaatcggagaatgaaagctacccagcctggccttacattctttcacttaatacataaacaagaagggggaaatgttgggagccaaaaaggccaaagggatggtgaccaactcagcattccactggaggctacatgatcaaacagcaaactgtttatcatgaatacagaatgtgggcaaactcgcttctgtgcctgcccagaaggtttgctgagggccatcgctccctggccccggctccttgaggttatctactgggacatctagagcctattgtttgaggaatgcagtcttgcaagcctactctggaccgagcagctgacctcttcttccacaccccttctcactatctcttttgcctaataaatatggagggctgtgtaaagctcagggcccttgtccactagaggcaaggtgtcccctgacccttcttccaaacataaaaaaaaaaaaaaaaaaactcgag

SEQ ID NO: 2343 - DNA, 1556 bp, Homo sapiens
ggcacgagtttcatccccagctgtaattcaagatgaggaagtgttttatcagtcacttatgtatcagcttgattaggtagatcatggctcttttcagaatatttttagtagcttggtttgtagcctttcttagtgtcaggaaattgaaccccatcctgagagcccttgaggagctttgaagctagtactgtgagcattaaactgagcagcatctaggcaattaaaggaaatggattttatatagtttggagtggcctgagctactttctcttgtgctgttttggatattgcaatcaggtgtgtgatgtttacctctggcaataggaagtggactccaggtggcaagaataccaaagccgagtggactccctcattccctggatcaaacagcatacaatactgatgtcagataaaacttttccccaaaaccctgttgaactaaaggtaaagtcaaggacttaaattttttttgtaaaatctttctaaggagtaagtctccaagcttatcactgctggcttctaggtgaggtggtatgaaaaatggggtcctatagtttgtgtccatttattcaccaaatattaattttataggcactttataaccaatatatacacttcaaagaaacagaaattctggccaaggagagagaaaaaggaagaattgaggaattatataaattactagaggtaagtgagcttatcctttgctgaacttggggtttgctggtctgtactgttgttgcttcttgattatagattccttgtttcttttcccaaactgcattaatagaagtactctcctggtgacaaataatagcaccactctcaggctggtcttaaaatgttgtggtaaaggggcaatgtcagccatctctgttttttaaagggcttattgaaaaatgacatgtatttattcagaaatcttgattttgtggacaaattttctgcttctcagaggaactaaatctttccctaggtggaaagaagagagacttctattcagaatttgattcccagagaatttgaagttgtagaaatgagaatttaaccttgccagataaaagttattgagggaaaggaggatttatagaaagtgtaaaaggaatggaatgacttagagtaggtagtccctacattctagaggtgacttttctgctctttaactcaagggtgaagaacctgatacatatttgattgtttttccatgttagacaataggaaaaactgctgaatggctgggtaaagaagcaagaagtgatgtgcaaataataaatcaaaactgggacaagagggcatggctgtgtttttggactgaaagagtatctgtttcaggtgtggattgaatttggccgaattaaactgcctcaaggttatcaccctaatgatgtggaagaagagtggggaaagctcatcatagagatgctggaacgagagaaatcacttcggccggctgtggagaggtgggtccagatcctgagagtggtctgacattatttattgcgctccagcctgagcaacaagagtgaaactccatctcaaaaaaaaaaaaaaaaaaa

SEQ ID NO: 2344 - DNA, 2185 bp, Homo sapiens
aaaggcccaaataattcccacaattgctatttcagaaataatttttatttggctttgaagtcactttctacctcccactgccctggctgttcctgctcatctccctgacgtctgagcttggtgagctccagcactcagcccttaggcttcaatttctttcccactcatgctctctaggttagtgtttctcaacgagggcactagttggaattttgagcctagtggaatttggtataataataactcatgatgagaaaccatcccatatattgcaggacatttaggatctctgtttcctgccatttaatgtcagggatgtaccctcctacccccagccttcargcaacgagaaacactgccacacataacctgatgtcccccggtgaacatcactgcttggtgagctcaggtataccaaggcattaaatacctgtgttctaaagactccagaatatatctccctggctcagatctgactgcagacttgcagaccaagtatttgtctaatcagtgtctcaaactcactgtgtccaaaacggaacccttgatgttgtccacatctcctgcctgagtctgcccaatctcagtaaatggcgccttcattctaccagctgctcaggctcgatgctttggagttgctcttgatttctctgcgtctctcagcaaatgcctctaarctctgtcttaaaatatatccattatctgacctcttctcagcacctccagaccgttggcatctcttacctgggttattgcagtagcccactgcttggtcttcaacctccactcttgagcatgtccatatcagggatggtgttaaacatctcagtctgatcaacatcaccactcagctcagccattttgggcttcccttatcactcagarccaaatcctgtggtgagagcagcctacagcacgcaggargacctggscccacaatgtgtttctgctctcagctttggacagtctcttctccactcactctaccccagccagactcacctcctggcccttccactgacacgtgagggcctttacacctgctcttccccctacctggaatgctcttccctcagattttccgactccttcagatataccctccctcagggataccttccctgaccaccctttccagaatagcattccctgactcctgaccctgcttcatttttcctcatcactgtcagacttactgtgtgtctgtctgggtatttgtttctatgaagcagatcctccctaacggaatctaagctgcatgagagctgggagcctttttattctatctccagtgcccaaaggctgtagaagggcctgttgagacacccaggtacacatttaggtagttcacgcctggctgttcttgtgtctttcctggctctgcctttctttcagtaggctcattcttgaccagggaacggcaggccccccagtatccctgcagaatctccatcaagcacagactggagcactttcccagagggcactcaccggccagcttcagctctgccagctgtgttcctttcccaacaagaaaaggcctctgaacagatgtaagaattgaggcttttcctgatgggtctgtgtttgacccatttcagagcctgcagtgcagtacctgattgtatccatgagtcaaacagctcttattatctcctccccagcccatggcagagttgaaggaggaaagtgcgccagaggtaagcgtgctgacagttctgtggtgtgacagcctcacagtttggaaagacaaaattttaaaagcttagtagtccacaggcacttgtagaggcagagaggcagacccgataggcctcaatacggtggcacactgcatctcatagttttaaaataatgaagactggctgagcacggtggcttacacttgtaatcccagcactttgggaggcctaggtgggcagatcagttgaggtcaggagtttgagaccagcctgatcaacatagtgaaaccccatctctactaaaaatacaaaaattaggcatggtgacaggtgcctgtaatcccagctatttggaaggctgaggtgggagaatcacttgaacccagggggtcagaggttgycagtgagctgataccatgccactacatttcacatttcagcctgggcaacagagycgagactccgtctcaaaaaagaaaaaaaaaaaaaaaaaaaaaactcga

SEQ ID NO: 2345 - DNA, 1649 bp, Homo sapiens
taaaattcatgattttgggcaaaaaaaaaagcatatcaaaacaaaattttaactactaatgggaaggttaaaaagctgccacgtatttctagtacaatgtatccaataagagcaaggacattgttaaatggaacaagacagctgggaaaggccccactatctctaatagaattgtgctactataaaacatgaagatatcagcaatttggccacttgcagtttttttcagcatgttaaagcaagtgctaagtactttattagtactttatttagtactttattttaaaggtctagaaaacaacagtcttcctggaggccccagaatccctttcatgggattcataagggactcaggtattcttattttctgccaaaaggtgtgcttatttagggactcttttacgatactttgtttctgaagttaggtagatcttggtttactgtgccaaggtcctacctagcattccctgtaggaatatttgaaattccactagctagtctaagaagtcaaagcacaaaattaattgtcaacgcttctctcatattcttaaaattgaagcagtttgcagggaagaacaagaatgaggtgtccctgccttggtaaagcaactgccaaattttgttctagaaagaatccccaagtgtgtggatctattataatttctttatcttttatgaatgagggcatcttttctacttgagcaagatcatggtccttgaccagtgggcttttccttcatatctgtcttgtgtagttgtgcttttcctttggctcgtttttggtctgtcagggtaaccagcagtgcacaatatgagacaaatgctctttagagagaaatctggtgagactgtagaacccagagcaaaactgtttttttttcagtctctgttttcttttctaaatgctatagaaaataaaggcacctgaaaagaaactactactttaacactgctgtggaaggcctttgctttataagaaaaatattattagctatgggaaagtaatgttctttatgtaaagacttaaaaatagactaatagtttacagagttattatataaaatacgatgtgaatttatttcaaacaagttgtgaaggtaccaaaaaccacaataaaagttaatatatataaaaactactagaacaaaaaagcttgaaggtgtgggggtggagggtatggaagaccaaaagtaaatttaaaaaagaaatttttgaaaggaaacagctttatcaggggaagttaaatataacactccgtttttttcttctttctaataatgatatggatcaacaaatgcaatttgaactttttaagataactctaaatgtgttttgtttcttaaatgcacaattgattcttctatactgtaatgcttctttgctgacgctggaaaatggtcagactgctgactttgtgcctttaaaatgcattctgctttgacagtggcagactttttggtgctggagaagattcactagcagtcttatatgtgcttttcaggaaatatctttctacttaaggccttgagagattcaaagtggcatgacttaggcttggaccaaatataagatcttttacattgcaaacaaaatgttgtattgaataaaagggttaaaaaaatcataaaaaaaaaaaaaaaaaactcgag

SEQ ID NO: 2346 - DNA, 2665 bp, Homo sapiens
ggcacgagcggacagctgctgcagggcccatggcggacacccagtacatcctgcccaatgacatcggcgtgtctagcctggactgccgtgagccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcatacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcgggtggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgagggccacaagaggggctcccgcttctggatccaggacaaaggccccatcggggagagttacatcgggttcatcgagagctaccgcgacccctttggttcccgaggagaatttgaaggtttcgtagctgtggtgaacaaggccatgagtgccaagcttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcaccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacatgacagctagggttcaaaacgttctcaccaaatccaatgctcctcacatattaattttataaccagacaaataaatattagagacaaccaccaaaaaaaaaaaaaaaaaa

SEQ ID NO: 2347 - DNA, 1258 bp, Homo sapiens
  misc_feature (805)..(805): n equals a,t,g, or c
ggcacaggggsagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctarggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctngggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcatgttatggttttgaggatttgctaaaaaaaaaaaaaaaaaaaacc

SEQ ID NO: 2348 - DNA, 1027 bp, Homo sapiens
ggcacgaggaaggttttcttctgcacatgtatttgtttgatctgccttttgtgcgtggggtgggagttaggtaggaatcttaaagtggagagccagtttcttcccaaattactgacctaacccatccttaacccccagttcaaggccacctttgtgatagtgaagcttccacatgctcactcagccccttctgctctctcttcttctctactgtgcatgtcggcttgtacttttgccagtttctctaaagacacaaccagaggtggggtggctgtgtgtgcacaacttcaactttacatgtggggctgagtccctatgttgtatatccttgtgcaaaagcacaatatgttaattgctatagcttttaaaaaaataattaatagtttttcataatcaaattttcttgcttttttgttttttcaaaaaagcatacttttattgaagaataaaccccttatatatgtacacttatttataactatgaacctgaactaggatagaaatgcattgtgtatattacaaaacataacaaaaataataggggtagggaggtgcagatgttggtcaaaggatataaacctgcagttctatgatgaataagttctggacatctggaatacagcatggtgactatacttagtaatactatattgtacacttgaagcttactgaaagagtaaatctcaagtgttctcaccacacaaacccaaaggtaactatgttctcaccacacaaacccaaagggaactatgtattaattagcttgattgtggtaaccatttcacaatgtatacatttgccaaaacattatgttgtatacctggaatatataattttatttatcaattatacctcaataaagctgaaagaggggattactaattcccacaaaatacagatttaacaaaaacttttattcaacaaacagtgctatgaagttgtaaattggaaacaaaagaaataaaatttcatccacagtcttctcatcaaaaaaaaaaaaaaaaaaaaaaaaaaaaaaaaaaaaaaa

SEQ ID NO: 2349 - DNA, 1248 bp, Homo sapiens
  misc_feature (8)..(8): n equals a,t,g, or c
aacctttnttagttgagcaaaagamcaagcaatttgcttttgcaamcaataaaaaactcacttttttwatatgkgcttatcttatcatgattccatttttacccttaaacttttataggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaaaaaaaaaaacggcacgtaggggggggccccggt

SEQ ID NO: 2350 - DNA, 1019 bp, Homo sapiens
tttttttttttttttttttttacataagttttacaagataatacatttttacagtgacctgatgtggatacaactttgcaacttggcaaaaagcaaatcttaacttacattataattaatttgctgcattttacacatctctgattctcaattttggcaagtacaacaggttaagggttctatttagtgtccccttctgatgaatatgatgatcttgaacccattcttcctcctcaagcacggtcatcctcctctgatggcaacagcagaacctctgggaaaggaacctttcggtatccagaactcccaggtggcagcccagtgtgggatttggagcatgacaacaaaggcattttctcaacatttactaaaggagagtggggtgttctatacgctactgatggggactgtacatgaacacatttaaattgaattacaacaacattttagataggaaatatagaatcttataagaacataatctaaattataaccaattttaaatagcaaagtttaacaataaagctacttaagtgtttgaattagaaataaacagtaaaacatctgtattaattataacagagttgacatttgttatattttatcttcagtattaaccaaaggagtggaatttagccagggttgcactttttaaaagttgtatatacttttatttattttacaaaaggaaaaaaaaagacatacttttcccataaaattccaggtcttactatgtaaaataaccatgcactacttcatgttataatcataattttagactatttccagtaggtaagtgtcataaagaaggaagagatatggcttccacagcttcaatgaggtgtaaggctagaccatattgcccatgtttttctggtaaaagctcaattactttatttactagtttagctgttgttgcaattggcacttcagtgttttgaaggtcctgggggtccattgctttcagccaagtacacagtgtgggtggaagtctggcaagcagctccattcctcgtgcc

SEQ ID NO: 2351 - DNA, 1309 bp, Homo sapiens
ggcacgagagattcacttgtaaatgttttcgggctccctatactagaatatgagttcagtgactgtggagatttttgtttggtctgcatgctgtatttccagcacctcttttcaccctttcctcgcattcataagactaaaatttatcataatttggatgtcttttaggattggaactgttggagtaagatcgtattgtcatcttctcactaaagattttgcaggtggaattatgtgtggatgctacctttaatttctagcattaaaattctgaagttactttattatttttctgtttgggggtggggttttttttgttttggacagagttttgctcttgtcgcccagcctggaagtgcaatggtgcgatctcagctcactgcaacctctgcttcctgggttcaagcgattctcccgcagtagcctcctgagtaggcattcaccacaccctgctgttttgttacttgtttgttttttgagatggaatctcgattgatcgcccaggctggagtgcaataatagcaccatctcagctcactgcagcctccgccccccccagggttccagagattctcctgcctcagcctcccatgtgagctgggattacaggcatgtgccaccatacccagcgtaatttttgtatttttagtagaagaaagggtttcaccgtgttggccagactggtctcaaactcctgacctcaggtgatccgcctgcctctgcctcccaaagtgctgggattgggggcatgaaccaccgcacccagcctgaagttactttggaaacaaatatatttgtatatgacagcttgtaaaactgtagtgagaagagcagaatcatatatttctcagtgaaaaagaaacaaatcttataatgaagcacagaagaggctttaagaattactgataccatcttgccttttctcctttgttggtaggaaattagtaaataagccaggtttgatggctaaagagtgatttctggagttttttaaaagttaaaatcttttcttattaggcatccacctaccccaggtttgggaaatggtattgaatgttgggctttcccttgtgttttagtgattatttaaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaaaaaaaaaaaaaaaa

SEQ ID NO: 2352 - DNA, 2255 bp, Homo sapiens
ggcacgagctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttggtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtggttttttaagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattccactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgggtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattgaaaaaaaaaaaaaaaaaaaaaaaaaaaaaaa

SEQ ID NO: 2353 - DNA, 1659 bp, Homo sapiens
ggcacgaggagaatctgccttctgatgagagctgtctttctcttgatgatcttgccaaaaggatagagattgcagaggttgttcctactgaaggattggtctccatattaaagaagaggaatgatactgtaggagatcatcctgcccaaatgcaacacaaaccatctaagcgaagagtgagattccaagaaatagacgatagcttggatcaagatgaagttggaggtggctcctgtattttgctggtcttgctgtgcatagcaacggttttcctcagtgttggaggaactgcattatactgcactttcggtgacatggagtcacctgtttgtactgactttgcagacaaatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcataaaagttggctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaaaaaaaaaaaaa

SEQ ID NO: 2354 - DNA, 2845 bp, Homo sapiens
  misc_feature (813)..(813): n equals a,t,g, or c
  misc_feature (836)..(836): n equals a,t,g, or c
  misc_feature (927)..(927): n equals a,t,g, or c
ggcacgagataatatataaaaagtaataaatataataataaagttttttaactttaaaaataaaacacgctttaaaagcaactgctacctcccctcccccccactaataaaattctagtatgataaaaatgaataccctgctttcattggaaatttctagcttacactttctctctcactccgtttctccttttctgtctctctctactccttctccctccctccctccctctctctctctgtctatatcaatttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttgagcaaaatggctttcttctctgggaatgcactgtactcaaagatataaggtattagactagaggctcccttaagttacggctagttctaacgttctaaaactctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgtttgattagtaatgtgaccctttctttcccatgtttagtgatttagaatctagaagagaagtaaaaaaagaagaaggtgaagctttngcacgagaacatggactcatctncatggaaacgtctgctaagactgcttccaatgtagaagaggtaaataagaggccctttaaaatcttcatctttatacttaatagaaatgtnttatatatcttcattttacttattatttaagtttttagtcggatggtctttgaacatcataaagtaggaaagtttcttccctttgaaatcccttgtaacattcaccttctgtcagactcttaaatcatattgagccttctaaagcctgaatgttttcttacatttttgtacgtattttcactccctccctttttctaaacaatttcctatagtttctgagagttatattttaatcacattcatagaaagtcagtctggccaatggaggagaatagtgtagtcctattctttcaaattatgttgagcaaaatggcttctctgggaacccactgtactcaaagatacaaggtattggacttcttcgtgttgcatggtagggaaatcttttttgtgttgcatgggagggaaacaaggaaccacactaatgaaatttggaaatgtttcaagacagcagaacgtttgtagctatttatatccacttctgcttattttttttaattttatttatttttttaactgtcaatatattaccacatcaccacttctgcttaaagtattctattattgctgtgtaacattttacaaagcatgagaatcctgtttcatctattgatgaaatttgtattatttcatttatttccattgatgaacctgaactattggaacttttctgaacacagtgtatccttttatgctgtatgtgtttgtgtttggaggtagtatgtatatacatattataaatagatgattacatagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttctcttagtagaccttggtgccagaggaatgacacagtgatgatttcccttggttttctttttgccacatacccgagactgggtgctagagaaacaggcaacctagaaaggtcaacaggcacagaaaaaggaaagtcttctagccagagaaccaggaaataggcaggtcagaacagtgttcgcaagccagaacactcttagaaagtaaccattctactgtagccaaacatcacagaaaaaattgtggttctgcttccacaatccccaggcagtaatgaagtagcacctaccaccaccatttcccttgttggagtggagtgagaggaagccaactaaacagtggtttaaataagacccagagtctcataacatagtatctaaaatacccatgtttcaatagaaaatcattcatcatacctagaaccaggaagatcttaaattgaatgaaaaaaagataataggtgccaacagtgaaatgacagtggtgtttgaattatcttacaaagattttaatgcagcaatcattaaaatgcctcaacaaacaaggaacatgcttgaaacagaagagtcttagcaaacaaacaatctgagcaaaagaaatgcaagataaaaaaaagaaccaaataggaattttaaaaaaaaaaaaaaaaaa

SEQ ID NO: 2355 - DNA, 1647 bp, Homo sapiens
ggcttttactcatcccttcttttagaaaatgctgccttgacagtctgattttcatggtatcatgatccgctatctcctgatgtgtcctctgtacatccagctgctctttctcactctcttatttgtgctctcacttccttaaattttaaccttcttctcgtgctgcactttctccaggtatatgagaaacctctccatttttcactttcatctgtattgctctttgcctgttggcctcaatttctcccaccacaagatgagcccctatacgtatctaagaatgtggcctcaagaaccccagtgtggcaatcccagtgaaaagccttttcccagtactcatctttccatcctggggaaggcatgggattgcttttggttggttgtgtacctaccctggcacacagcactattatcagagtgatgggccaatacaatatatggtgagggaaatgaggttccatgattggccccatcagtcacaaggatggaaaggcagtttcctaagacagatgtatcaggcaggagagaggagctatacaatgtcaacagggaaagtgtaatataaataatcatgaactaataatagagggttagccactaagggataaaaagaagtctaaaggttacagaaacaggtgaatggataaacaaaatgaaatgttattctgccataaaatggaatgaaattctgatacatgctaccccatggataaaccttgaagacattatgcaaaatgaaataagccagactcaaaagggcaaatattatatggtgccacttatacaatgtaccatgaatagtcaatccataaagacagaaagcggaatggaggttttcaggagctggaggaaggggagaatgggaagttattgtttaatgggtgatacggtttggctctgggtccccacccaaatctcatctcaaattgtaatcccatgtcaagggagggacctggtgggagatgattggatcatggaggtgattcttgtgatagtgagtgagttctcatgagattcgatggtttaaaagtatgtggctcccttctgtctctctttttctctctctcctgccactttgtgaagagatctgccttgcttaccttcaccttccaccatgagagtgtttcccaaggcttccccaggcacacagaattgtgaatcaatcaaacctcttttcttcataaattacccagtctcaggtagtatctttatagcagcgtgagaacagactattacaatgggtatagagtttcaccttggactgatagaaaagttttggaaatagatagtggtgatggctgcaaaacattgtgaatgtatctaatgtcactgaattgtacacttaaaagtggttaaaatgataaatgttatgtatgttttaccacaaaaaaaaaaaaaaatacaggccagcctggccaacatggtgaaaccctgtctctactaaaaatgcaaaaatgagctgggtgtggtggcacatgcctgtggtcccggctactctggaggctgaggcaggaaaatcgcttgaacctgagaggtggaggttggagtgagccgagatcgtgccactgcaccccagcctgggcaatagagtgagattccatctcaaaaacaacaaacaaacaaacaaacaaaaaaaaaaaaaaaaaa

SEQ ID NO: 2356 - DNA, 640 bp, Homo sapiens
ggcacgagaagaaatccaaactacaggctctttaatgagatcttccaaattttaaatgtcttctcaactttttaaaatgaagattaaaaactgtgtgacccaaataaaacagacatgtccacatatgttttttagggaaggatttttgtatctgttcactgctgtattcctaggctaccaaatgaattcagcctgtaggcctcgaatttgcaacttctgacttatatgtaaataaataataaatgtattttttcttttttgagacggagtcttgctctgtcacccaggctggaatgcagtggcatgatcttggctcactgcgacctctgcctcctgtgttcaagccattctcctgcctcagcctcccgagtagctgagactacaggcgtgcgccaccacgtctgactaatttttgtatttttaatagagacagggtttcaccatgttaaccaggctggtcttgaactcctgaccccaggtgatccgcccacctcagactcacaaagtgctgggattacaggtgtgagccaccgcacctggccaagtgttgtattcttaatcatctggaaaaaaataaaaaaaaaaaaaaaaaaaaaaaaaaaaaaaaaaaaaaaaaaaaaaaaaaaaaaaaaaaaaaaaa

SEQ ID NO: 2357 - DNA, 706 bp, Homo sapiens
ggcagagagatcacacccttgcctattactaaagatgaagggaaggatgtttattcagaagaacagagagcttgcctggaacagagctacttgcttgtatgttgggttctcccatatggagtgagtggacacagaaaaccatgctttctgccttgaccttgtacatatggcttatgtgacctttggcaaatcacttgctttctctgagtctcgttttcctcgtctctaaaaaaaaattaaaattgaatagaggatggtgtgagatttcagcaagattaaaaggtataagaggccagtccactgctgggatatggagtgtggtctgatgatccttttaaagaatggctgcctgggagttggggagtaggcggctgtcatatgaaagaccctgggccaggtgcagtggctcacgcctgtaatcctagcactttgggaggccaaggcagaaggattgcttgagcccaggagtttgagaccagcctgggcaacatggtgaaagcccatctctaccaaaaatacaaaaattagtcattcgtggtggtgcaaacttgtagtcccagctccccagggggctgaggtgggaaaatggtttgagctcaggaggcagaggttgtagtgagccgagatcatgccactgcactccagcctaggcaacagagccagaccttgtctcacaaaaagaaaaaaaaaaaaaaaaaaactcgag

SEQ ID NO: 2358 - DNA, 1264 bp, Homo sapiens
  misc_feature (1211)..(1211): n equals a,t,g, or c
  misc_feature (1256)..(1256): n equals a,t,g, or c
gctcgtgccgaattcggcagaggcaacccaggcgatggtttgcggtgaggggtaattgaagaggctgtaacgttttttgctgccaagagagaataaattatttaagggaggcattagctactgcgatwtaawtcgtatcgctgggtgtaatrcccctctccccattctgggtataaaaatgttggctgcattgttgtgttagtgtgtggggatcaaggaaaacccataaaatctctttaggagcaaaggatgtaatttaatttcgttcctaaagaaagaaaagtatctgattgcagawtacacaatatattaaaacttatttttctacatgtacttctggaagggtcagatcaaggttttatttagtgtttttattccagtactctaatattttataaataagtagttggagatgagcccagtcacaggacaratttttacygaaagtacctttawayctttagtttgattaaatggcagtctcttagacaaatgagatgaaaagatcyctgcctatttycagactttatttattgkaagcttgcagtataataactctgtcttttaaaaaatgactttgaattaagtgaataaagaaaatcatccaggaaattcagtcagtggcattcttaatctgtcagcacttagttatcgagctccttgattcttatacgaaggtaccctttgaattaaatataatcctgtgatttattacttaatatttagagaagatatgtattttgatattacaaagtccattagaaactaaactataacaataagcatactaatcttactgtttctttaaaaaagaaggcacatgtaatattgacatatacaaatattcagtagacgttagatttctaaaaaatgagatcttgattttttaaaaaacactgtttacagaattttattaagtttaaaatttagagacaggaatggttgacagtaacttatctgaaaaatttctcagtgaagctcgctggttttgacatgcttgttttttgtaaatcatcatatgctttttgtatattcccacaattgataaaatatttcgtacatttttcatattcaaaaagcaaactttcaaacgtatgctaaatttaagggattacaacagaacattccaraaagatgaaaagtatttgctaaaatgattgtggttactatttttggacccgtgatttgtgatttaagtattttgaaaagcngagtatcttcttggctgtgtaaggttggagtgggtttagagtatntttgtgta

SEQ ID NO: 2359 - DNA, 2249 bp, Homo sapiens
ggcacgagcgatcatgaatttttgcgtggaaccaagcttttggtttataaattgatcagtaaaattattgatgtaaaaaccaatgtacagtgcattccacaactgtttatgtttagcattgcacgtactcacttttctgtatgatgtgggcagctcagtaaatcttcagagaaaaatctgactcagtcaagtcagggatcctgaaagctgcagatggcacaaagaccttttacaagtgacctggcttgatcactgcacacgccatccctggtacctgaggcagaagacacatcttgtgcttccctagtcatcaggttcatcacttcgaagcatagaagctgtagactgaccccgtcaacagaagggtcatttaagacagtgctgatcactcttaccatggaatattagcttttgctggtgggaacattagcttcctagtcaccaaataactgtatgtgggataaaactgaaccttgaactgcctcataaaatgactttatattttaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaaaaaaaaaaaaaaaaa

SEQ ID NO: 2360 - DNA, 1450 bp, Homo sapiens
ggcacgagattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacagtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgagaactataaacactgtttttcttatgctattggaaaaccaggagacttaaatcaaccatacgagattatcaacagttctaatggtaaccatatattttggcccatgggccattctggaatgtatgtatttcgtgtgaagatcctggatccaaactatagtttctgtaacctaacagctatgtttgcaatagagacatttggactgattcccagtccaagtgtctacctggtagcttctttcctcttcgtcctgatgctgctcttcttcactattcttgttttgagctactttcggtacatgaggatttatagacgatatatttatgaaccacttcacaaacctcaaagaaaacgtaagaagaattaggaaaactgaaagtttgtttattacagatatatgcatatagagaaacagtgtattacatagtgatattgagaggtgtgtttgccctaacatactatatataagctcgtagtaggcatcaccaaattcaagatctggatatattctgaactatctcctaaatagaatgttttcatatatattgttattaaattaatcctttgtttgcattcatttttaagatatatatgtacttcacatggcatgaaaaataaactaaatttgactattaaaaaaaaaaaagaagta

SEQ ID NO: 2361 - DNA, 1645 bp, Homo sapiens
ggcacgagctaagtaatcaattgaggttattccaaccaaacatttaaaatatccttattaagtgtccaccagtgagtggtactaagtgtgacatactgtgcacaatccttgctctcaagaaacatgaacagcatagctaggaagaaaagttggagaggacaccagggcataagcagattcgcactgcaagataaagcaaaaagaagataagtgccaagtaccagatggaatgaaatcatgttccttttgctctcttgcccagcctaagaagacaggccaggggagtttgtgatcatggtacagaaatggaggctattgctcaatttgctcactctgccccatcggtcaaaattgctattcaaaatgtgccttactccctattttgtatttagagtcttggattcttatttgaaacttggcagctttggaagctgtcttatattttgttctgctttaagactttcactgccaagtacatattcaggctttgtttgccagtttttttgattgtgtggttgaatgccatccctggaaagatgtacttttgagctagtatgaagtcaatgagctgccttcagcattcatgaagaggttctgaagtttctgtttcaaggcttttgacatgtcagcgtgtgtaaatctagtctgatgccaagatgccttatgccaatgggttccttttgattttggtatgcatgattttccttgtgcatattaacctgttgccattaaaagaaacagaaaattataagatcatgtaatataacataggttctagccacaaataacattagtactgtatcacaacactagtggattttggtttgttagaatttttaactgtcttggcttttttttaatatcctttctaaaactgtgtattcaactcctgatttttcattcaacccatgatgatgcttcctgactgctcagctggaatctggatttgccttctttcattcagcacacttctgaagcagtggcaggtcttgtggggaattttgggggtagcagattcaaatttggcaggaccctggggacattaatcaattggaaaatatcaatgagcaaatcatttctcagataaaatggttcaattaaaaatgatattgaactgaaaaaaacaaaacgttaccaaactaaaaatgtgtacaattcataggctccacgatacgtttattttgtttctatgtactttttaggcttgatcttaccatctttataatttaaataattggcaataacttataacttgttgtaatgataatgagttcacctttactacttactccctgaccgatgttgtggccctctccagtgccttcctcgcttttattatgtacccacagcagcctaatacacagccctgtggccagcagcttccacaatatttgttgtggaaaatactgattgatattttgggtgaaaaattgtaacttaatggtactttatatcattattaaacatacataatatttcaaatattaaataattgcaatgttcctcagataaaaacacgtctatccaacctggccattggaagtaagagaaaacttcccacagaaaactcttaatatattatttttgttgctgttgttgtctgtttccaatgtttattcttttgtccaaaaaaaaaaaaaaaaaa

SEQ ID NO: 2362 - DNA, 979 bp, Homo sapiens
  misc_feature (9)..(9): n equals a,t,g, or c
  misc_feature (23)..(23): n equals a,t,g, or c
  misc_feature (976)..(976): n equals a,t,g, or c
gaactcccntgaacaaattctgnagctccaccgcggtggcggccgctctagaactagtggatcccccgggctgcaggaattcggcacgaggtaaattccaaaaaaattcctaaaagaaatgttcccgtgcccctgccaccctcactcactaggaatgcaacaatgcattggacaggagggtctcggcaatcggcttgggacccacactgtctaggaaagaaacttctggtttccatgtgctgactgagcaacaaccccttggaagaaatccttgaaaaactgggatgttctatggagggaagctactcatgagttgtgtaacttaggcaaaggcattcaccttttctgagactcagttttcttcttatcaataaaatggagctaacaataggcaccttcagaattatgatgattaattggctcgtgttttctcaacactgtcaattgttcttgaggtcactattgttacccctacttctatgcacccaccatgtatgcatggaatgtgctagaaggggaagaggtagtgggaggtgatcctggggcaaatacagctaagacctccccccatcctacatgcactcattcttctctttcctctgktagtctggaaggggttggggctgttggaagaaaaggaacataaagcagagagaaggatgcagtgagggtgtctgggactgttggcaggcarcagtcgggtttgggggctacagggctctgcaattgaggaagccagaggtggatgaagagttggccacacctctcccctaaagctgcagaatcttctgactataaaaagagctggtgcattcagaatcctctacaaccagtccttcccctgaccttcccagaagcttcgaaccctcagtgctgagctgccaagacgagctgggtgactaacatagccattctccagtttggggatgtcagaatgtccaccccttccccacktctgggggcggaccgaacccgngcg

SEQ ID NO: 2363 - DNA, 2952 bp, Homo sapiens
  misc_feature (1145)..(1145): n equals a,t,g, or c
atttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttgggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctrtttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagatttataccatgggaagaatatgtatggtggatgaaggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgnagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtyatgcattctgaagcagttggcttttttttaaccataggaagtcatttccctctagctccttcccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatgg

SEQ ID NO: 2364 - DNA, 1117 bp, Homo sapiens
  misc_feature (35)..(36): n equals a,t,g, or c
  misc_feature (1096)..(1096): n equals a,t,g, or c
  misc_feature (1114)..(1114): n equals a,t,g, or c
gggactttttactggtaaagctcacaaaagctggnngctccaccgcggtggcggccgctctagaactagtggatcccccgggctgcaggaattcggcacgaggagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgttaaaaaaaaaaaaaaaaaaactcgnggggggrmccggaaccgngtt

SEQ ID NO: 2365 - DNA, 860 bp, Homo sapiens
cccacgcgtccggtttctgtgtatgctttgtatttttcattgagaactggatcttttgactgtaatgatataactctcaaaattcagattcttttccttcccatggattggcgatgttacttgatgcccctgcaatcatctttttattggtggcttttccaaattattttcacaaaaactatttttcttattatatgtagtcaatgatgactctcttccattacttcacggcgagcagtgctttaacagagatttcctatattatttggatccaatgtaaaatttttttaaaatgtgtttatcttttcataccttcttagactgatattactggtaaagctgcttcagcctgaagtcttgaaacagtggccagtctctgtgccagacacttagcaatcacaagcaattgtcaaaacatacaccgtaatttttgaagtacaatatacctatcatccaccctagcaccagcaagccacactggaattgttggcccccatccacgtggttgttcactatgggactgaagggtagagaatgggggccattatagaaaacagtgaatttcactgtaatgaaccctgactctttcttcataaagctatcatctggagactacaagtgtccaaatagactcgagaattccaaagtagtttctctagatacttcttgtcagttcaataactgttttggtaaaggtactaagttctggagcttctcactttgctatcatctgttatgtcattctaattttctattttctaaataaacctttgtaatctaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2366 - DNA, 1086 bp, Homo sapiens
  misc_feature (519)..(519): n equals a,t,g, or c
  misc_feature (531)..(531): n equals a,t,g, or c
tcgacccacgcgtccgcaaataccatgtggctggtaaaaatgatggtgtaaattatatttacagactgataaacgtaaaaagtatctgggacatagcattattgaaaagaaagcaggctagtgaatactataattattttgtaaaagtctcttatggacataagttatatatttacatggccatattttgcacaggaaatatgaaaaagtatatatatcaaacagtaatggcttatttttatcttctgggagttttgcaggtgcttccctctttacaccattatatgtcatctgaagttttgttctgattctgtattatttcatttctaaaagaaaagccccaaaaccaagtgctgttttcctggtctgtggaaacagagtctccgaggaattaggctagacatggtaagaacaaagttctgttgtgataaaagctttggcctgaggttccaaccattcagtttgccagctcagacttgatcttgaacgarggcggggttctgtgactggagaccattncycycctttkgnatttgttggtgtgtccaaaamcctcagatctcccagcttcaggcttctttgaggscagtgctaaattggttgaaacccttatttgaggcagttcctgaaaagggtaggtgaaatttcctgctgataaaaggcatcytgtgtcttgttcatccttagcaaattgccaattagcaaagaagagagggcagatgaagtaccagccaatttgaaattggtgtggacttccatcaaggtatattaattcattttacctagatgattcgaaattagttgcttttttcttttaatcctaaaaggataattttcttcatgttcttcttgtcatgtcagccaaatcctatagtgtcaactttcagtaaatgtatcttagaaataactatggaccaatctagatctttctctctctatcatctatacagtttagagattttaaaactcttaccacttagtttgaaattttattttaatttataaaatgatatattcttatgtaaaaaattcagacaataaagatgtatttaaagtaaaaaaaaaaaaaaaagggcggcctagagg

SEQ ID NO: 2367 - DNA, 969 bp, Homo sapiens
  misc_feature (10)..(10): n equals a,t,g, or c
  misc_feature (969)..(969): n equals a,t,g, or c
acccacgcgntccggcaacttcttactcccccaacggcttcactttccatgctttgtttgttcttattagcatctatcactatctagcatgtagactgtacttctttttattttgtttgtcactctcccctcttagaatggaagcactgtgaggacagcattttatgtgcatatgtgcgtgtctattttgtgcctggaacacagggggtacttaatacatttttgttgagtgaacaaatgaatatgttgagcctcatcatgactctgagctgaacaagctgagcatcatctgcatcttacagatgaggagactgaggctctgtgagcctataaaatggggagccagatcaaagccaggtctcccaatgtcatgacctttatatttttcccttcaccggtaatacccttagacttggtcagtggagatcctcccttgggcctcaaattttagagcatcccggagtctttctctggctgtaccccttaccattaagtgggatacagtggctgcctggagtttgtcctgcctcttctagatcacgttgcaggtacccaggactctggagttccctgctcagatagtcttgagcctgctgacaagaccaacattgggggtttcttcccaggctgtctctactcaacctgggcctgaaggatgggcacagggtggttgcttatagaatatatgggtagaatttgaacatatgggctgcaaggatccacccacatgtgtacaaggcccctggtgatataagatggagttaggagcagaagagaagtgatacagtaagaagtgtaagaatatgagcacaataactgaaagtaaaatctcaatggatacattaaacattaagttagatgcagcagaaaagagaagcaatgaactacgagatacatctaaagtaattatctagaatgcaacacagagagagtaaggtataaaaaatccaaataagagttcaaaaaaan

SEQ ID NO: 2368 - DNA, 1206 bp, Homo sapiens
ggtcgacccacgcgtccgcccaaggcagcccagccccgtctctgccctggtggattggtggggagctgcggagggaaacagcagccaggactacttcaaggcaaatcagggcccatgacgggggtggttctggtggctgttggggaggtggctatgaagatcctgcttctctgcctctgcctcatcctcctcagagtgaggtcttgcaggaggaaggcagcaagggcagcattgggcatggaggctgcagacgctgtcacggactaatctccagactccagactgcttccagatgcctcctcatccagttcctccacagtctgagcggccgtgtttcctctgcaggctttgcatggtctgtcccctgctggactctcctgatccctcctttccctgtcacccaacatctccccaaaccctccgggccaasgactmtgcggctcttgacactttgcacgtgtagtttcttctcctgaaacacccttccctcctgccaaaccacgtctggaccctccttcaggttcactttttttttttttttttgagacacagcctgggcgacagagcaagactgtctcaaaaactaaaacaaaaaaacaccaccaccaccaccaatgtctgattaaatctaagccacggttccattttggggcaaggggcagggtgtgggtgtggtggacagagaacgggctccagccaccatcagctgcacgtcctggtagcacctgagccattcccagtctcctgtgctgggagatcatcatctaatcctgatgatgacgccctcctctcagagctcgggggatgagctgccaaaacccatggaggttcaaaacccgggctctggagacagaagacactgggctcagagacatggggccactgtccaggctttccctgggcctggacctgggctccttccactgtctgagcagggtcagcctgggctggctgtgctggttcaagagatgagggaggaggacacagcggttgccaggaccctgaggcactggactgggcactgccccaaggggcagaggatggaacccggtgttgatattgtgatgctgacccgtctgctcacctgatttgggtgctgaagggcagctgacccccctaatcttttatagacttgtgaaacgaaaataaataaaagtcaagctgggaacagcttagggcaaaaaaaaaaaaaaaaaaagggcggcc

SEQ ID NO: 2369 - DNA, 1623 bp, Homo sapiens
acccacgcgtccgcatattttcaatgattggcatagcgcctggtctactaaatgctagcttatcgtcattattattattctcattgttattatttattgttgtaatagcaaagcttaattaaataataatgatactaatgatggtgatccgtttcctgctagtcccacttcttattcccaccactgatcttcacgcaactgccaattcctcctgatgttatttgccataagtaatcaatacatgacaacagggttagaatcactgttgaaggaggcagaacaaagtgaaccatggacaggttgtagagagagatgccccgccatggggagggaaaggacattcagctgaaggctcttaggagacatactccttagggcctctgactgtgggctgtccctgttctcctggtctcccaggccctctgcactgtcttggattctgctccccacctgcctttcttccctgctctcctcactgcctgcctgaaaatgccttctgccagccaagtcctcacagtggagtgaaataatccttttaccgtggggtaacgagagggacatccaacctggagttggaactaaggtgcttgaatccttccctgcccttcgcccctcagatgactgtgtttatggacctaggtggctttgtctatgaagcatgcatggcacagtgccagccaattccctctttctgaagcaactgctagaatactgaataccttccctgaaggtaaaatacaaatattttttaagtgaaaaatgaaaatacatttctgaaactgttttctacatgctgatcacaaaagggaatagattactatccatggtcctcttttgctctttttcctctaatctaatctcagtttgatgtcctctctccttgaaagattatatacatagagagcctaattattaggctgcccaaaacagctgctatacctggacagaacgctcactgaggtttggtcaccagactcagacaaggttgaacacggtagcatctgggacaaaaatatgcttgcaaaaatatattgaaactgaaattttaaaagggattctttctctgcttctgttttctaaagaraattatctgcacaattgttctctgtatgtcacttcatttgacatgaacttttcaaactgcaggttttagctagctagtttatgcctaaaacaaaggaaatastgattgaggagamcagtggcatggtggagagtgagtcctttctcagctgtagatatgacctgggtctcctaggctttggagtcagactttggctatgccactttctggctgtatggctttgggcaaattacttaacctttttgaacctccatttcctcaactgtaaattggagctgataatagtatccatctgtagggatgtagtgaagataatatgaaataataaatgaaaaatacttggcacatagaaaggttttgattaatattagctatattgtttttaagacagagtcttgctctgtttgccaggctgaggcacaagaatcacttgaacccagggggcggaggttgcagtgagccgagattgtgccactgtactccagcctgggtgacaaagtgagactaaaaaaaaaaaaaaaaaaaaaaagggcggccgc

SEQ ID NO: 2370 - DNA, 1370 bp, Homo sapiens
acgcgtccgaagtaatattttattgacatataatgcacatacagtaaaatttactacttcacagtataaaattcagtggttttagtatatccacagagttttgcaatcatcacaactatttaattttagatcattttcattgctactcccaaaagaaaccccatatccgttagcagtcattcttcattacccccatcccctagcccctagtaaacactgatgtattttttctgtttctgtggatttgcctgttctgggtatttcctataaaaggaatcatacaatatatctttgtgactggcttcttccacttattgtttttaaggttcatcatcagtacttcattttactgccaaatcacattccagagtatgtatataccatcttttgtttactcatccattgatggacatttgggttgtttccactttttggctattataaaaaatgttgctaggaacattcaaatacaagtttttgtgtgaaaatatattttcatttctcttgggtatatttgtaggagtgaaactgctgggtcatacaataactctatgcttaacattttgaggaactgccaaacagtgttccaaagttactgcaccattttataatcctaccagcattgcatgaggattccaaattctccacattcctgcccccatttgttatggtcgattttgattctagctattctaataagtggtatcttattgtggttttgatttgcacttccttaatgactagtgatactgagcattcattcctatgatggttgcttccattctatgagttgccttttcattttcttgattgtcttctttgaagcaccaaagactttaattttgatgaagtatgatttatcttttttttgttatgcttttggtgtcataatcaagaaagtactgcctgacctaaagtcacaaagatttaccccaacagttttctcctaacagtttcatagttttataggtttagctcccacatttaggttgatgatccattttgagttaattttggctatggtgtgaggttggaatctaacttctgttgtctttatatggataaccagttgtcccaacaccatttgttgaaaagacaatttccctgttggattgtgttagactcttgtcaaaaataaatttgccataaatatgaaggtttatttttgaactcccaattctattccattgatattttggtctatccttatgccagtatcatgctgttttattgttaagttttgaggctgggatttgtaagtgctccaactttgttctttttaaagattgttttgattattcttggtcctttgcatttccatatgaattttaggatcatcttgttagtctctgttaaaaaaaaaaaaaaaa

SEQ ID NO: 2371 - DNA, 751 bp, Homo sapiens
  misc_feature (5)..(5): n equals a,t,g, or c
  misc_feature (20)..(20): n equals a,t,g, or c
  misc_feature (82)..(82): n equals a,t,g, or c
  misc_feature (124)..(124): n equals a,t,g, or c
  misc_feature (135)..(135): n equals a,t,g, or c
  misc_feature (144)..(144): n equals a,t,g, or c
aaggncatccagttttgccnttttcactggtgaaagaaaacccccttggcccccaatacgcaaccgcttttcccggcgcgtngccgatcattaatgcagctggcacgacagtttccccgactgnaaaccgggcantgagcgcancccaattaatgtgagttagctcactcattagcaccccaggctttacactttatgcttccggctcgtatgttgtgtggaattgtgagcggataacaatttcacacaggaaacagctatgaccatgattacgccaagctctaatacgactcactatagggaaagctggtacgcctgcaggtaccggtccggaattcccgggtcgacccacgcgtccggtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctctaaaaaaaaaaaaaaagggcggccgc

SEQ ID NO: 2372 - DNA, 2329 bp, Homo sapiens
  misc_feature (12)..(12): n equals a,t,g, or c
  misc_feature (2292)..(2292): n equals a,t,g, or c
  misc_feature (2305)..(2305): n equals a,t,g, or c
tagaaggaaacnggaacgcctgcaggtaccggtccggaattcccgggtcgacccacgcgtccggttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatgggaattatgctggaagtctcaaataatatttttttcctattttatactcatggaagagataagctaaagaggggacaataatgagaaatgttggtgtgcttttctaagcatttaaaactaattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaaaaaaaaaaaaaaaaaaaaaaaaaaaaaaaaaaaaaaaaaaaaaaaaaaaaaaaaaaaaaaaaaaaaaaaaancctcggggggggncccggtccccctttggccctttgg

SEQ ID NO: 2373 - DNA, 953 bp, Homo sapiens
ccacgcgtccggaggatttctcttcctgttatatagccttttgcttccccctttcctcattccagctgataccccgagaaaaaactcagccataacatgattatgttgcttaagtaagtccatggtctttttcagtctcttaagttcctgtctacacagttttttcacaggatgcacttgatatggttgtgtgttacaggtttattcatatcagctactgaaatacatgctgtgtgtacatataataggtacattgtctctgcttattgaacttataaaataataataaacagctgaataaggaaagtaatgtaagtgttgttaagtaaaggactttgttgaagaagaacttcagtttttaacaaaaaaatgggagccagaagaaggcggctgaaaggtctgtttctctcatatgtggagtaaagcaaacaaaaatatgttttcttatatgtggagtaaagaaaacaaaaagccacttaaagagtcttgatgtttgagattaaggggtggatggtttgttcttcctttttgtccatagttttttcagagtgataatttttaattcccatcgtcagtaattaaagaaagtgatattttttacactttttaaaaaagcttcagtatttcatgttaacctgtgctaggtttaactgaaaggtttgggattttttagttgttttttggggggtggataatattaaacgtaagactgaatttggccagctgaatctaattagggcaataagttgcattatttcatctctgaattatgaaaataatttgaaattttttttcttatatttcaggcctttttatggttatcatgagaaggaaagacactttatgaagatctatctttacaatcctacaatggtgaaaaggtacaaagataaatgaaaccaaaatatgaataactatcattgaagtattttaataataaaaaaaaaaaaaaa

SEQ ID NO: 2374 - DNA, 932 bp, Homo sapiens
cccacgcgtccgcccttagtcttctgggagggcagtgaccccagaagacgggcacaggtcatggggtgcagagaaactggtaggcagtggtggcactggggggcagaagaggccaggactctgggggtcccagggcagatgtggccaccgtgggggcggtcagggcgggccaccgtgaatccttaggagggctccaccaccgactggcccagtgaacacagccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaacttctccctggaccagcccggtggaacctggatctgaccctgattccgtgcccgccttccaggagaagttgtcacacttcctacaagcttcccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggccctgaggctggagcccccatggccagcccagcctggctctgttctctgtcctgtcacccatccccactcccctgggtggcctgactcccactccctggtggccccatcccccagttcctcacgatattggtttttacttcctgtggatttaataaaaacttcaccagttaaaaaaaaaaaaaaaaaaaaaaaaaaaaaaaaaaaaaaaaaaa

SEQ ID NO: 2375 - DNA, 1812 bp, Homo sapiens
cccacgcgtccgtggaaatatgtttgtcacaggtaaaattgtcacttgggtaaattttatctcaagcaactcctttttagttttaatactttctatgttgcccaaatcaagtcttatttccatgaatcactgttttatgtaataattttcttggtgaggtcaatttacatagttttggtactttcatgtcagatttctaaggtagtataatttagtttagaggaagaatttctacacagatcatgcaattgtctcttcattatatatcagggtaaaatctacaaaaaacaaaattggtttgagaacaaagctgtcattacttgcaagatgaaaacagaaaaattgcatgtgtttattaaaacacagaagtatattcctgtgcaaattaatgcagattctgaagtgaaagacaggacttttgagagattttgagtccaaggattcacctcttcaaacacaactgaaaaaactctattttttttatttttaaatctaatcagtttatatatgcccaggtccagcaaaaagaagctgggttgataatgtgttttgcagttattcaagctagtttgaaagagtacctggcagtgattgtgaagaccaatgattgtgctactaaggtctctcaattgccagacacccaccaagtattttttaaatatgctattctgttttgaaactcaaaaccttgtatttttgttaatctagttacctgccaaatcaaacaggaatccaaagtttcataaccctgctgtattctctggttactagaaataagcatatttttgatgttttaacaaccttttaaaataataatttctaataatgaaatagaatatttctatttaagtagctattgggtatatctttacataactagatgattatattaaatgggttttttagatgaatgatgtgcatgggtagatatttttaaaatgaaatatgttttttccttttttacttaaatttctttttagaacatactgttatgaacattaacatttattcaagtccttgggacaattcttcttcagttacccagtaaaattttcatgatctctgcaaaacatagaattagaaatataaaataagataaattttagaatacagtgagatgacttacacaatttgataattttttatataatattttatgattaaccagttaactgaaacctaaaaacctgtattaactgattaatattgcagcaaaatgtcagttcatgttattgtatcaatcacttatggatacatgattatgctgtcgtgatatgatttctaacaattgtctggtcatttttagctttactattataattttaattaaaatatattaaagtcactatgtcataacagactttatattgtgccatgcagtcctattgctcttttgtttcaaatatcatatagtctaaagcaatgattctcattaaatacatgcatcaaaatcaactgcagttattacatgctaactcaaacttacaaaatcaagctctctgtgatcctggttaatacatctaagtacttgagccgataatccaagtactttggggggtcgaggtgagaggatagcatgtggccagaagttcaagaccagcctgggcaacatagcgagactccatctccacaaaaaagtgttaaaaattagccagacatggtggtgcatgtcttagttctaactactcaggaggctgagaaaggaagattactttagcccaggagctcaaaggtgcagtgagctgtgactgcactccagcccgtctaaaaaaaaaaaaaaaaaaaggaaagaaaagaaaaaaaaaaaaaaaa

SEQ ID NO: 2376 - DNA, 594 bp, Homo sapiens
cccacgcgtccgcccacgcgtccggttatcacctatgttctcatattatttttatctttttttgatcagtatagtttgcagatgataaattttattaataaaatgttaatctttagttttcatcgatgtttttaactgtttttctgtttgttattttatttatgtatgcttttatttttgttattacttttttttttactttagatttacttttgtcttttttgtcccctagtttcttaggtggaaggcaaggtcattgactggagactgttctttttttctattgtgggcctttggtgccataaattttctcataattactgttttaatagcatcccgtatgttcttattttaatttcattcagttcagcatactttctaacttcttttttgagttattctttgattcatgagttatttagaagtatgttagtattcaaatattggacattggacattggacaatggtttttctgttaatttgtaatttaattttgctgtcatcaaacaacatactttgtattattttaatacatttaaatgtatcaaaaaaaaaaaaaaaaaaaaaaaaaaaaaaaaaaaaaaaaaaaaaaa

SEQ ID NO: 2377 - DNA, 909 bp, Homo sapiens
ccacgcgtccggaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtgtgggttttgttttgtttaatttattgattagtctttaaagtaggcttttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2378 - DNA, 1463 bp, Homo sapiens
ccacgcgtccgtgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtctgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggtttttttaaaaaattaagaaaaaggaaagctattctgtattgcaccttttcacaatttaatacattttcttacattttcctgtgattttcgaaactaaaccattgtgtgcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaaaaaaaagg

SEQ ID NO: 2379 - DNA, 809 bp, Homo sapiens
gggtcgacccacgcgtccgctccttagctgttaaaacaagaaagattgagtgatattatgtttttatttctgagaaaaggtgtgcaaagatgaaagctctcatgattaacgttattatatttgtcatatgaatttctatgtgactctgtacagagtattccctcttgctttttctttgtctctcactctctctttgaattttctaagattacataattccataatgaagttcacgtgacgtctcactgaaaggtacacatactattccttttactgcccgatagataaaagactggattaggacccagagagacctcccttattgaagatagtcaaagaatttgaccttattgccatcttttaatagtatataaccgatattgtgtgttctttcatttctatctgtgcctctctgtagggattagagatggggaattagctttatcaagcctttgggtaaaatgtaaaaactgagctgatttgtctttggcatctcagtaacaaaaatatagatctgattttaacatttacagcactgcctgtgtgctgactgcctataggtgtgcaaagatgaaagtwattctttagaataatattaaagaaaggtttattaaatggcacagtacttctgaagacatagaaacatataaatgatgcaatataggttgctaagcctttttcctcccatttaaaattatcagaacaattttaaatggatttaagccaaaaaaagggactttttttggatttaagcaaaaaaaaaaaaaaaaaaaaaaaaaaaaaaaaaaaaaaaaaaaaagggcggccgc

SEQ ID NO: 2380 - DNA, 1583 bp, Homo sapiens
  misc_feature (892)..(892): n equals a,t,g, or c
  misc_feature (897)..(897): n equals a,t,g, or c
ccccgggtcgacccacgcgtccgcccacgcgtccgaaatagatccccaggcattaactgtaataatgaaataccagagtgaatggaaagatgttattttgcttttacacgttccttccccaagctttcatggtggtacggctctaccaatcttaagctttgtttatgcatggcctattctaagatcatctggggacaaacctgaatgaggaggtctcccaaaagagcaacaggattgccaaagtaaaagttgcatcagggtccaacctaaaagtactagccaagtgtctcaactcttagattggatgctgtagggggtcaacctggmcattaaagtcattaccacaccaaccatttctgtgtattagggttatccttctttattttcagcagtagctattatttcagccaacacctatccaaaccatgccaacaatataggaatatacttgattctcagcaaaggtgatttcttcggacaaaggaaaaaatatctatgcacaatggttagttggttcaaatgcacacatacggacccagcataagatgactgcctgatgtagagccataagggaatcgtgggatccaggtcttccatctgtaactcatcctcccacttataaatattaccccatctttcttacttaggctgctgcttgtctctgctcatccctccacctctgttccccacctgggggcmgctgaacyyggactattgcccagctagatgttaggatgaaggcccattctaatactttgctggtaattctttttaattatccacaaatgtctaaacattttctggcccttacccagtcccaatctggcagctttacctattccagtggttctcaatcaggartgatttgctccccagggaacacctggaaaantctanargaattctgatataactgggagggggtgaggtactactggcatcttgtgggtagagagtasggatgctgtttaacatcctgcaatgcacaggacaggccctgacmacmaacagttatctggccccagatgccaaaagtgccagagttaaagaactttgccttgtacttcatwattgtgtcctccatgctaatgtttctcaccacttaaatattgtagatgttttcaggttgattgtgtccccacccacatctcaccttgaattataataatcaccacgtgtcaagggtggggccaggtggagataattgaatcatgggggtttcccccatgctgttctcctggtagtgagtgagtcttacaagatctgatggttttgtaaatgggagttcccctacataagccctctcttgcctgacaccatgtgtttgcttctcttttgccttctgtcatgattgtgaggcctccccagccatgtggaactatgagtcccttaaacctctttcctttataaattacccagtctcgaatatgtctttattagcagcatgagaacagactaatacaagggctaattttttttgtttgtttgtttcttttgatagggtctcactccagcctggccaacagagtgagactctgtctcaaaaaaaaaaaaaaaaaaaaaaaaaaaaaaaaagggcggcc

SEQ ID NO: 2381 - DNA, 352 bp, Homo sapiens
  misc_feature (12)..(12): n equals a,t,g, or c
ctgcacttgccngccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggakgggacagggcacgggctctcagaaaataaactgctttattggaattaaaaaaaaaaaaaaaaaaactcgag

SEQ ID NO: 2382 - DNA, 453 bp, Homo sapiens
ggcacgagagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgaaaaaaaaaaaaaaaaaaaaaaaaaaaaaaaaaaaaaaaaaaaaaaaaaaaaaa

SEQ ID NO: 2383 - DNA, 996 bp, Homo sapiens
  misc_feature (514)..(514): n equals a,t,g, or c
  misc_feature (574)..(574): n equals a,t,g, or c
gcggcacgagcacatctcatcttccactggaacgtttagataaaggagtgtggggtgtaataaagaactaagctaaagcgagagaaacactgaaaaactacgaaatgtcacacaagtaccataaagagagtgattacttgattaattaatgataggaaccctacatttaagtctttcagttatacttgcatcagtcctctttgcctatcagaatgcggtttgtttctgccaacgaataactatcaaaccactgaggcctaactgatgtgtgattaatgtgggctccattaattgtgtggctgagttttatgcatgaagctgtatccttgatttttcacctttaatttcctcctgtttaactgctggtcataaaattgtttcaaatgtatctgctgagtctgagagcaagttttgcaacttgaaaagtgcctgagtcagtttgggcaccttgtttggtaaaaccgacttgggggaactcttaacgctgtaagatgaattgctacttggcttccantcccagccctgctggctcccttcctgccactgctcactggcactgcatctcatctattancattaagcacatgcatagcattgataatggcaaaaggcttaataactttctttctgatagcccatcatatgtggctctattcaaccttattttagacagctagagatgatgacatctgtctttctggtctttttcacattcatttaccatctctgttaatatcacctgattttcttttggggcagcaccccttcccatctctgcttttattttctgtgtttcaagtagggctggtctcatttccctggctccggagctaggcctggacaattagaattccagtgattggttcggggataggcatgtgacccaagctcggtcaactctcggtcaactagagagacaacctaggtcaactagacaggcaaccctaggactttagcaggaactattaggagaaaaaaaaaaaaaaaaaactcgag

SEQ ID NO: 2384 - DNA, 2444 bp, Homo sapiens
  misc_feature (1655)..(1655): n equals a,t,g, or c
ggcggaggcggaggcggccccgggctcgggcggctgggatggagcagaagagcgcggacaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccamcgaccamcatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctygggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggargargatttgggttgttttgttaggggttactttcaggggaacatttcatttgtgttatttcttaaacttctatttaggaaattacattaagtattaatgaggggaaaggaaatgagctctacgaggatttcaccctgcatgggagagagcanggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaaaaaaaaaaaaaaaaaaaaaaaaaaaaaaaagggggggg

SEQ ID NO: 2385 - DNA, 2444 bp, Homo sapiens; identical to SEQ ID NO: 1089
  misc_feature (1655)..(1655): n equals a,t,g, or c

SEQ ID NO: 2386 - DNA, 895 bp, Homo sapiens
ggcacgagttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaaaaaaaaaaaaaaaaaaaaaaaaaa

SEQ ID NO: 2387 - DNA, 1320 bp, Homo sapiens
  misc_feature (1024)..(1024): n equals a,t,g, or c
  misc_feature (1309)..(1309): n equals a,t,g, or c
gcagggtttcaccattttgggcaggctggtcttgaactcctgacctcaggtgatctgcctgccttggcctcccaaagtgctgggattagaggcgtaagcaccgcgcccagcccctatcctttttgttttttattataaaagtaatatctgaatacatgattgtttaaataaatgctgtgtaagtgtataaaatgaaaagtaaaaggcccccatgaatggacattaagatacttccgatgtgttttgttttctattgctgcagtatttgttactgtacttgtgatggtacatgtgcatatattgctctaaaacaaatttctagaagttgaattccaaacagtgactgttccagatgtcttattttttaggaccccaagcctcttaaattcaggtctttccgttattcccttaccttctcccttatcccttcaaatctttgcccactgccatcacattaatgccttctttgaccttattttatctgttatagtaatgagctgccctgttctttctatctttaatctccccactccaccttgtccttattatctcagctagtttaattcttaaaagtgagtatattaatccttggaatctttcttttttatatatatatatagtactgatatttttcagttagtagcttctgattataactttcccaaattgaggctttcatttccttagaacaaggaactgccctggctgggcagtttagtcaaaggcttgtcagggtgtttagtagacagttgtgcaagtggagctattcacagggactgtattactatgttcctttgttactaaaaaaaaattcttgcagtccctgtagttcgcaacagatactctgactcatatttctctacataggagaaagagtatggactttggagtgatacatctatagctcggttaggatctagactctgctcccaaactggtagtgtattttggggtgcactgctatgtttctgagccttcatttcttccttataaagagtttattagtttgtagccaggcgcagtngctcgcgcctgtaattccagcactttgggaggctgaggttggtggatcgcctgaggtcaggagttcgagaccagcctggccaacagggtgaaaccccgtttctgctaaggttacaaaagttagccggacgtggtggcacatgtttgtggtcccagctgctcgggaggctgaggtgagggggtcgcttggatccgggaggcggaggttgcagtgggctgaaattgtaccactgcactccagcctgggcgacggagtgagactccgtgtcaaataaaaaaaaaaaanaaaaactcgag

SEQ ID NO: 2388 - DNA, 1227 bp, Homo sapiens
  misc_feature (1164)..(1164): n equals a,t,g, or c
tataaaagtaatatctgaatacatgattgtttaaataaatgctgtgtaagtgtataaaatgaaaagtaaaaggcccccatgaatggacattaagatacttccgatgtgttttgttttctattgctgcagtatttgttactgtacttgtgatggtacatgtgcatatattgctctaaaacaaatttctagaagttgaattccaaacagtgactgttccagatgtcttattttttaggaccccaagcctcttaaattcaggtctttccgttattcccttaccttctcccttatcccttcaaatctttgcccactgccatcacattaatgccttctttgaccttattttatctgttatagtaatgagctgccctgttctttctatctttaatctccccactccaccttgtccttattatctcagctagtttaattcttaaaagtgagtatattaatccttggaatctttcttttttatatatatatatagtactgatatttttcagttagtagcttctgattataactttcccaaattgaggctttcatttccttagaacaaggaactgccctggctgggcagtttagtcaaaggcttgtcagggtgtttagtagacagttgtgcaagtggagctattcacagggactgtattactatgttcctttgttactaaaaaaaaattcttgcagtccctgtagttcgcaacagatactctgactcatatttctctacataggagaaagagtatggactttggagtgatacatctatagctcggttaggatctagactctgctcccaaactggtagtgtattttggggtgcactgctatgtttctgagccttcatttcttccttataaagagtttattagtttgtagccaggcgcagtggctcacacctgtaattccagcactttgggaggctgaggttggtggatcacctgaggtcaggagttcaagaccagcctggccaacagggtgaaaccccgtttctgctggaattacaaaaattagccggacgtagtggcacatgtttgtaatcccaactactcaggaggctgaggtgagagaatcgcttgaatccaggaggcggaggttgcagtgagctgaaattgtaccactgcactccagcctaggcgacagagtgagactccgtgtcaaatnaaaaataaaaaaaaaacaaaaaaaaaaaaaaaaaaaaaaaaaaaaaaaaaaaaaaaactcgag

SEQ ID NO: 2389 - DNA, 1176 bp, Homo sapiens
ggcacgagaagtgattcttaaatattaagtgataaatgcatttaaaatgtgtccggaatgggctttgtgaattccagaaagggaactaaattctgcttaaaaagagaaggcttctcaaagggagtaatgtttgacttgagacccagagaaggagaaaggaaggaagcttgcagaggagccttggtgacaagaggcatgctctattgtggggacagtaggaataggggagaagccttggccttgtcactttctgctttttggtttatgcagttgtctctgcctaagatttttttctacctttgtttctgcctccagttactccccctggaagtgtcactctcttttaaattcagagagccttgtttatggcactgatgtggtgcccagtgcattctgctttgtactaaatatgctgtatctcacctttgtgtcagcaccaaactgtgttctttataattctgcagcttctagtacatttgtgcatagtagcaactcaatgcacatttgttgaatgttgaatgaatgctagtcaaggcaagacaagcaaaattctcaaataagtcaaaataatccctaattatttccagatggaatggtaatcaatttgcttcaggaataaattagccaatggatgtttgataacataaccgaccctaagtaactcgatttagctgctgaagccagcttttaaagatgcagtttatccactggccatgggatatcggccatgattactggagcaagccctagtaatacaatctttatataataaatataatcttactaaatgtcagtgagaattatctttatataataaatacagtctttaaaattgtatttatatttggcatttatgcctctcagcactatgtaatttcttattagaagtacactttaacttgagaattccattagaatcattaaattttctgaatagaaagcttaacagtgtttaaaaataaatttttagtggcttcatgatgtcaaaacaatcacttgaaagctgaaaaatatgttaaacctacttttgtatttatgtcccagtttgcttttttcaattcacaaaaaaagatttgacttgattacaaagaagaaaacacagaaagagcaaaaaagaaaagaaagatgaaaggaaggaagaaagggagacaaaaaaagaaaaaaaaaaaaaaaaaa

SEQ ID NO: 2390 - DNA, 531 bp, Homo sapiens
ggcacgagctgactgtatacagggttactgttggggttattgtggggcagtgtaaggtgatgaagatctcactgacttagtgttgatggcttgagtttgagtcctggtattaccactcgtttgttgataatcttaggtaaataaactggcattgctaagccccagaaaaatgtatttagtggaacagatgaaatatgattcagtggttaggaagttaacttctgaagacagacaaacctaagtttgaatcatggttcaccccttagtggctttgtggccttgggcaagtttctttaattttcttatctatactgtgaacagtacttacatcataggtttggtctgaagattctgtgagataatgcatatcaagtggttagcactttgccaggcacattgttaagtgcccaataaatgtgggccaaatgtgatagctcacccctgtaatgccagagctttgggaggatcctttgagatcaccctgggcaatatagcaaaatcccatctctagcaaaaaaaaaaaaaaaaaaa

SEQ ID NO: 2391 - DNA, 1221 bp, Homo sapiens
ggcacgagcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcagtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaa

SEQ ID NO: 2392 - DNA, 1293 bp, Homo sapiens
ggcacgagtcagcctcccgagtagctgggactacaggtgcccaccaccacgcctggctagttttttgtatttttagtagagacgcagtttcaccgtgttagccaggatggtctctatctcctgacctcgtgatccgcccgcctcggcctcccaaagtgctgggattacaggcatgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccattttaaaatgtgaagatggacttcatgcaagttggcagtggttctggtactaaaaattgtggttgttttttctgtttacgtaacctgcttagtattgacactctctaccaagagggtcttcctaagaaagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaaaaaaaaaaaaaaaaaaaaaaaaaaaaaaaaaaaaaaaaaaaaaaaa

SEQ ID NO: 2393 - DNA, 908 bp, Homo sapiens
aattcggcacgagaaagggggtcgatgaccacttgtaaagaattgtgcccttggaattttgtgtggttcttttttgtttttgacttgttagggagaatgtcaaacatatataaaagtagactaaacagtgagatgaacatccaaatatccattattcaaagattgcttctgtaataaactcacagccaatgcggtttcatctgtacccacacccctttcttcttttcatatattttttttcattttaagcatttgcaataacttatttacctaaccacctattggtagatatttgagtattaaaccattaaaaaatttttgtaattaataccctttcttgctttgtggtcttgtgtgagttttttaaagataaattcctagaaggggtgttgggtcaaaggacatgcattaggcatgttttagtttttgtaaatttcttccaattttgagatgtcatcacattgctttccaacaaacctgtactaatttacgtttttgctgagttctcactttgtctttcacctagaatcactgtttgctttctctctttgtcttttatatatgtgtatatatgtaatatatgtatatataggcatatatatgtatttatatagtcccctgtgaaacatttgaggctctattgcagacattataactcagtactcttaatactttaatgtacatctctaagaataagacattttcctaatgtaattgtgtgatcacaatacagtgaccacacttttaaaacttaaaaaaattccaaatatcagtttgttttattggtaaatattttagtgtgccagacattaagtcctctttgttgttgttgaaacataaacaaaatactgtttttttaatgctttcaaagaggaaggcattgcaaaaaaaaaaaaaaaaaactcgag

SEQ ID NO: 2394 - DNA, 546 bp, Homo sapiens
cggcacgaggtttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaaaaaaaaaaaaaaaaaa

SEQ ID NO: 2395 - DNA, 1160 bp, Homo sapiens
ttaagtggtctgcccttccactgaaagtgtagctttttgacagtctcagccatataaacaggatctcagtttcatccttccatccatccattagaggcacaaggtctcatctcttttccttttgggcattaaaaccaaagttcatacattattgagacaggccgactctgctaaggcagcctgtttggcctttaagttttattgcttattttttgagtatgtatttatttttttgattattattatttttttttttgagctttaagccttcaagtttcctttttattcttgacccctagacatttcctttgcttgtggactcgggtatttgtttttaggtaatatttttwttccctatgacacagccctcaggagatcctgagaacatgtgccctcatttttaggtaattttaattaggaagggttttaggttgtctgatctgccttgttgctagaaacagaaattctcctatkgattgatttttcaaaccacttcttagtggcctctacaactactccagtcaggtcaagaatggctctcacattgccaagtcagtgggtatttttagtcttcatcttagatgacctttatgcacatttgtctttgtctaggaacttctgttggaaacatcttctattttaatgttattttaaatttttttgcttttgtaacattatgcttagcatgtgtgtccaactctttgacaatttctttttagttttctggtggcttccctttatccaaatttagtattgaaattcctcgagccgctgcttttctcactccataattctggccagaatttggtacttaaaatattttgtctaaaatattacaatagctacttaagtcatctccctgactccactctgttgtctttcagggcgtcgtccacactgtagccaaagtgatcttataaaaacataattctaatcatggcactcttctgcttaaaaatgttttaatggctttccgttaggttaaaatttaaaagtcctttgtagcctgtgagactctacatgagttgactccctagcttcatctttgagcatcttatttctttacttattataccatcagttagagttgattgttatataatccacagaagtgaattctgtccgatttaagcaaaaaaaaaaaaaaaaaaaaactcgag

SEQ ID NO: 2396 - DNA, 308 bp, Homo sapiens
ggcacgagggaaaataggcagcatgctaggtgtctttcagtgtctgggggctcgtgaggaccacctgttgttggacagtgagaaaggctaatgtttcttgttcttggttgaatcttgtatttaaaaaagtcattcaaaaacaatgtatttttatagttttgatgtaagtctaagaaaagtggaaaaatatgatatggaataggagtcttcttttggccatttactttctgtgtggccttagacaagttacctatttttctgaatctcctttcttgaacctttttgtaaattaaaaaaaaaaaaaaaaa

SEQ ID NO: 2397 - DNA, 236 bp, Homo sapiens
ggcacgagcaacctcaggacctcctcaagaagtggggttgaggcagaagaaaatgttcaaccctctgtctcctcatccagacctgttccttttgagccatctcatatagtgggggctgcatggatatgttttaagtaacagagttcctctgcctttaaaaaaatgtttgaaaactaagccatgagccaccacgtccggcctaaagacacttttataaaaaaaaaaaaaaaaaaaaa

SEQ ID NO: 2398 - DNA, 2024 bp, Homo sapiens
ctcgagttttttttttttttttttgtgttataataggttctttcactttattgcttattgtaaacactttggccatagcaaatgttagtttttaaataaccgtaattcaaaactttcacatcctatactatttttccccaagaagcatcatctatgaaaacaatcagtgaactccaacagtctatactggtaatgtgcacattgatgctattatgacacttaatacaaatagtaaaaatactcatctattgtaggcttatgggtttgtaaaatgccttaagggaggccataaacaactcaaagaagagatggtgtggactgaactggcttctatttggggaaaatttgcagaatataggaggtacgcaataaatgtttattgatggtgaagatgagaaaaccctatttctgctgatctttcctttccgttttccttaaagaatataaggtatatttgtattcagcattctcagaatcatcacagaaaccctggcactttgagagtcttagccacagtgtaattgggtctgaccacacgcagaagaaaaataaattaaagcatatgtactattaaaattgcactgaaaactttatgtaagtcagggagcccctcaccagaacaggctgaaactcttgaatgctttgcatcctcatatataagaaaatcatcagtgcttaaagatcaaggaactcattcaaaacaaattcagcctttggaccttactggcaggtaggttatatttcagtcagatcaatatctttctaatataggtatttgaaagtaatatatgctacttataataatgatatagtaagcttcttatctgcaagtacaggtactataacttacaccttaaaatgctttgtttgattgtttcattcagcaaaattcttggcactgttttgggatttcactgaattttgatgatgatattggattaagcattttagatttaattgtaaaatgacacaaaaatctaatcatctatttccaatgttcaatatacaatttttataaatacatgaaacaattcatataaaaatataaatgttaaggtcactcacagcaaaatatggcacattagaattatttattaaatgctttatacatataaaggtaggcacttcataaaatttgcattttggtaaaaggcaacaatttgatgtcagtatcttaattgtgtcattaacttttttaagagaacagattatcaaaattttacgwagaagaaaaaaataatagttttaagggaaatctacagaagggaatctgaacttcatttcccactttatttttgcgagtctgttgtgtatcttcatggtcaagttctgagatttttgctccctgacctaaaatcctgtgggaataattgatttctcatcttttacttggaagtgaagtgtctgctacctgtggaacttgatacaattttttttttctccccacagttagaataacctttattctgatccactataaagccagatgatttttaggtggcagtagctggcattgaagagttcttggcttcaagcggctgttgagtctttttggtcttgttttaactccctaattaaataaataagatccaactctttctgttgtattcactcctggacatatagaaattcacttcacacccacctaaaatacgagcagaacttctgaggcccaatgaacccatctactatttgattttgttatcccttctggagcgtgtctctaccaagagcttcacaaagcaatctagtcattgctctttcttgtactaaaaccagagtacccrtcctgtaacttccatcaggacctcaaacagtgctaggcacatagtaaactcttaggcactcaaaatacatttattgatgaatgaaagaatgaacaattctagttctgacttttaaagctatatagaataaagttgcttccttgtgtgggccaaatcattctcccatcctacttagatcttctttttttccaggatcaatactgaaactttcttcacctagcccttaaacaacatgat

SEQ ID NO: 2399 - DNA, 1345 bp, Homo sapiens
caggtgctgacctcgtgatctacctgcctcggcctcccaaagtcctgggattacaggtgtgggccactgcgccggccatgtttctcgacttctgctggcaagcatgttccagtatttgcatggctcctagccctcatctccatttctctgcacagatgttaccttccccatgaggtctgccttatacatgaggcctgtattataaactgcaactccgcattccccaaccccgttgtttcttctctccagaacactaggaacccatctgatctcctatgccttttccttattgtcagatactgaactctcagattacagttccccttcctccctccaggtggcgccatggaacgcagggccctcactggccctggggactgggtgacgacaggggggagcctctggtgattggctccctcaccctgcgtaagatcaaagggactaaaggacagccccgacacccggagccattgtggctcaggcaggttgcgcctgccctcgggccctcacggaggcgggggttccagggcacgagtcgaggccagcctggtccacatgggtcggaaaaaaaggacttttttttatcgttcccaatataacgacaaaacataaagggaggacgccttgataggaagaaatgacatcttcctaagtgtttttaaattacttccatgtgtcttttttttttttttttggggaaccgaggcttgctctgttgcccaggctggagtgcagtggtgtgatcttcgctcactgcaacctccgcctcgtcggttcaagggagtctcctatctaagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagggtctcactgtgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacatttttgtggagccagagtctgtataaaataaagtgtaaatagtaccataaataaagaatacatagtaccattttatagtagtataaaacggacattagaaactctgaacttaaaggttaaaaaaatacacaaaagtagttctcaagttctagagacttggagaatccaggaatcaacaatgtcgtggaactcctacagcctttcataaagaatggcc

SEQ ID NO: 2400 - DNA, 1376 bp, Homo sapiens
cgcacgggcgcgcgcatgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattacaaaaaaaaaaaaaaaaaaaaaaaaaaaaaaaaaaaaaaaaaaaaaaaaaaaaactcgag

SEQ ID NO: 2401 - DNA, 1485 bp, Homo sapiens
tacgagttttttttttttttttttatatttaagttttatttctttgagaacttatgatatacagtcatgcatcactgaatgacaaagatgtgctctgagaaagacatcattaggcgattttcttttccttgtgctaacataagagtgtgctaagcttatagcttattgctcctaggctacaaacctatacagcatgttactctactactaaatactatatgcagttgtaacacaatggtaagtatttgtgtatataaacatatctaggtagagtaaaaatatgatactaaagtcttacaggaccactgttgtatatgtggtctgttgtttactacatcatcatctggcacctgacattacattcatttagctaaacttaactgataagacatgagtgtttgaagagcaagattcatctgtagactttacatatacaatactcttttggggaaaataagaatataaagaattaaccttgaaattaagaattcttgcatttccctctagtgcctttcttgaacttttaaattcatatttttaattaaaaatttcttgatctaggctaggcatggtggctcacacctgtaatcccagcactttgggaggctgaagtgggcatatcacatcctggctaacagggtgaaaacctgtctgtactaaaaatacaaaaaattggccaggcatggtggcaggcgcctgtagtcccagctactcgggaggctgaggcaggagaatggcgtgaacccgggaggcagagcttgctgtgagccgagatcatgtcactgcactccagcctgggcgacagagcaagactccgtctcaaaaaaaaaaaaaaaatttattgctctgttcaaaaaatggagtcattttttaaacacatggagcagtaacccataatgaggtataatagacctaaccatgaaacacagaaaacttaaccatattctacttctgctttgtatatagtgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccaggtaactcagttttccttcactcaagtttctaatgattaagaaaaaaaaaaacactttaattcaatattaatgatgacactaagtgtatcatagataaatatctacaggagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaatcggagtttatccaagtaagtttttttaaaagcacctgcgaaattctgtttccaaaggaataagtcatacattaaatatgtgaaatatactctgccgaatt

SEQ ID NO: 2402 - DNA, 486 bp, Homo sapiens
ggcacgagcagctgctaactgtgtgaccttgggaacctaacctctttgtgcctcagtttcctaatctgtaaaattaggctgataacagaatcatagtcttgtaataagggttaaagatataatctatgtacagtgcctagtccaatttctagcacacagaaggtactgcataaatgttagctattattacgtttctgaaagctcacttgggtacacataacatggggcaagaccagagggtggagaccagttagatcgtcactgaggtcccttccagaccagtaaatttctgaataaagctttgaaaactagttgctcacttttaagtagctcacttcctgtcttgtttacattaagagacagcagaataatttttccagataatgcaaatgtgtccagaattagttctaatttgaattaataagattttattatacttttaaatacaaatctctcaatattccccatgaaaaaaaaaaaaaaaaa

SEQ ID NO: 2403 - DNA, 2401 bp, Homo sapiens
  misc_feature (1263)..(1263): n equals a,t,g, or c
ggcacgaggctttttataactcttaattattggcaataaaggtgagaaacatgtaaagagccaaataagacaattttatatacttgatatcgttatgacacaaataaaactgggtaatggaaaataaagggccagggtgatgtgttttttgtgtgtgtgatacttcagcaaaggtacttgaagtcatttctgaaaaaagacaaaagaaagctgtgtctatcctgatgctgaaaagaaaaaaaaggcatgtggtgataggtttataaaagtattactggtagcagaaacagtacataccaaactcttatgtagaagaaatcttgatgtgatcctagagaagaaataagtagaataatgtggaatagagaagactaggattgagaccatgaagtaaagtacgtgtaagaattacttttactaaacttaaaaatttttctatatatttgtatttatgtctatatttataaatagatctagaggctttgtatgcctgcatataggcatacagttctaaaaatatgtctttatttaccaaaggttatggtaaaatttamwgacaacaaaaacgagaaaaaaaccccactttactaagaggactccagctacgctgtccagtaaggtagatacacacaaaatgttgcaacttaaattttaattaacagttttaaaaattataaattcaattatttaactacattaactatatttcaatgaatatatagccatatgtgtgtaaagattacttctttggacaatgcaggtatggaacatttaagccacttaagacagttttcttggaaaacactggtgtaaagtcacagccctgaataaatgttaaagaatagattttactcctaaattattttgtttattttgccttgttacgtgatattgagtcagacatgcagttgagagtaatgtttaagaaattgagcaaaatatttccagtcccaagttagatgactaacacagattttaatagatttaatgtgttattccaatagcatatgtcaggtacgaatatactgtaacatctctcaggaaatatttatataacatagatataattaattagtcaataaccattttaattytatttaatacttatcctagttatgtggktttaggttggcagtttaatctataggaatatattaagactgatagaggraaagagaaagawtatgaccctttgataatgacamcagamcatatactattcttcctctttaatatcatattttgkgaaaagyttatgttttncactcagaattttcctcaaagttcaccgattatttcttcaaggaattttcaccttatctaggtttcagtatgaatttagttgattcattatttgagaatagttagggtagaaagcagagaaagatacacagtcaagtatgaaagtattagaatgtttgattttataactcacatagagaaatatctacatttttacattgttttattttgtcccagaaagaatgtcattgacctgttttgtaataagtgtaataagggataattagctcttaagattttatatttttatttgaacatatctattccaggaaaatgtacaaaacatattttaaatatycagctatttttatkgcctycaattattttcatttggaatatcttttttattttaaagttttggtagaagcagaamcaaaataacagaggacatctttaaacaaagcataataaaataatattaaattttattttactaaagatgcaaaggatttccataatttaaaaaataaattttaatttaactctgtaatttataagatatttctaaaatgtgtcctgtttataatttcagttcttgttagtatttctgtcattkggtaggcaataagaacattatttctaatcatgtaatgaatgaatgatatcagggtattagcgtaatttcagttaagaaaataatacttagaatattagtacctagaatattagtaccttgaaactcaatcatacataatacgaagagatgccttctttatttcctttggaggctttatttactaacttcatctttggtggtttccttttaaaataattcaccaaaacagtaaatttactttgtggaaagcataggcctccactctatcctactgtcttttgctatatatcttacacaaattcagtgatgttcacagaataatagagaacaccagcaaatgtactcctctatttcctttaagtaaaatttattttatccttttttatgatcccatcattcattcctttaaacattatgaattcttcattgcatccctgggttatgaawattgtggagttttagaaaattggataacatctctttacaggttataagatggtgaagaatcttaaggattaaatcagtgaactaatttagctcgag

SEQ ID NO: 2404 - DNA, 2970 bp, Homo sapiens
gtggaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacaggtcccagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatgattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattcaaaaaaaaaaaaaaaaaacgggaggtt

SEQ ID NO: 2405 - DNA, 2184 bp, Homo sapiens
gcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggtgagggggcgatcctcagggtgaaagcaggcagatggagaatgcgtgcagaatcccccaaatctgtgtctcacgtttcttctcccttttgtccttctgaggctgtcagtgctgggaaacactgtttttttgcgtgtttgtggtgggtcatatccaagttctttcaggaccagagatttgttggactggagtgggccacagactgacccttgctccttgactacaggatatccaggtacctgtgtgccctctctgtaatgtgcctgtgcctgtggccagaggggagccccctgaccgtgctgtgggagagcacattgacagagactgtcgctctgatccagcacagcaaaaacgtaaggtaaacattgtaggggtcagccacaacccagctgggactacggatgcctggaaacccaaacagctaatcagagtctcagcagagacaaccttctcacttcacctcagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgtaaaaaaaaaaaaaaaaaaaaa

SEQ ID NO: 2406 - DNA, 3852 bp, Homo sapiens
  misc_feature (2098)..(2098): n equals a,t,g, or c
  misc_feature (2111)..(2111): n equals a,t,g, or c
ggcacgaggaaaaaccagaggaaaaagcttaataagttacctttagcttttcttttctctgaaatgacacttcatgttagtatctcccaggagggtctattttctagacttgacatgttttgtggcttttcttctgcttgtacaatgcagtgtcctaactgtgtgcccacaggtcactgaggaagagtagggagtacagctctcagaccttttttttttttttttcaagttctttcctcttggatccatctggtccccattttcttcaagttggctttcagggagctgcatcataatcttaggatcaacaacagcttagggtccacggtgaccttctgaacctcgtctgtctgattcatgccttgctagtcagtcgccatcttggatgtgtgcttcacccagctttccttcattggctggcttccaacttattcctggtcagtgtcccgcattgccagtcttcttggattccaggcctgtattttgaggcataagccccttttcccaatgttggtgttctgccaatggatagaacttaatccttatttatgccccctagttactcatggagacactgaggatgtttatctgcctttcacacctcctgggccctgaagggaaaaaactctgggttcttctgaagcttttagtgcgtagttcttcttttcctactaaattgtttccgtatggaacaaccagtgtgggagatgatttcacctcttgtcatctttcctaagtcttccttgaagtgggtaagttccttctggctgttactggttccttggtgctgccacctccactgccccccactcccccttttttatagatccctaaatcacatcaaattgttttatttttcaaatcactaaagttgcctttctgccttagatcgtcagccagctctttgcagttaatgaggatccaattatgaaaggcagctgctcagctcctccatcttctatcccccacccccagaaatgtttaggatgacttctggctggtgaatatcagctgttgtggttgtctcctaggaatggcatggctgagggctttgtggtttatatctgagcagttaggggctcttttgcagggggaggaaagacagggggacttttgcttctacaaaggaaagactagtgccttgtctcctgggtgaggcttgtcattgggatggattcacaggcgagcagaaatggcaaaatttatggggcccgtgctcccagggggtggccgctccttcagggggttccacagtagcagaaaatgcattatattttgggatcatttgttagtgtctcatttctaccatctgtatgagaataaacagaagctgcaaacagagcctatcattcccggaacagaatggggtctggcttccatctcccagagatggaaggcttaggcagggaaatacacagaagcctctggagtgtttttcttggggtctactgtgggaatgaataacttggaggtgaaattacagcctgataacgagcatctaagcttccagagatggattcttacaccatttgctgaattttgctctgctgtgaatttgctgtcatttgttcattcatttattcacttagttattatttcaacaagtattattgatgatgctttctgcgccagaaatgatgtaagcactggggtcacccgggcaacaaccagccctgactgctgcttaccacctggaatcacagcgctgctggccgcgtggccacatggtttgttcccggcacagttttgctacaaggaataggtcttcctgctggccccttccctgttctccttagaggaggccaggggagacgtgcagctcatctacagggccctggagcggcctcctagcgtggcaggctgcagccctctctgcattgcaggttccattccagagggctgagagggagctctcttactgccactaggctccagtccagctcagagtttgggggatcagagaacattgaacacccacatgcgagaggtctcaggggctatttctgtgtctgggctcccatgcaggctaccgtggagttattcagggaacttcctaaacctggatctccatggggggtggagggtcctctgtgcaagncaatgaccctctnctgtgggctggtgtctgaaagcccaccgtgagaaagtcattccttctgctgaaggcgtcgttacctattggaccccagaaagggaaacaaagaaggaagggtgagaaagctttggtctagaaccctgggaccaggagtcgagccctggctccaatcctctccagctgtgtgaccttggggaggccatttagcctctctgagctttagtttcctcctgtcaaaatgaggatgtggtttagatgagcacagggcctccttcagctctaaaactgtaactcaatgtgattgagcctcagatctttttctgatggcccaggggacacggggtgaaggaaggagagaaaggatgtgagtgggaaggagtgctaagaggaccgggtatgggaggcacagtaggtagagcacagttagaggagcctgaggacaccaaataaaaactctggggcaagccagggagctatgggcagaggctttatgacagatgcagcaggcatgctgaggatgaaatggcgggtccacttcccattcccaggcacctcgctttagacaccttgctttagacaaagtgatggccagtggaaacctttgtgcttgagggtgcaagttactcacatgctttttctcttagagaaatagaacttattgggaaatagactctggacttggacagggaaccaaatttcaccttcaaaagtgaaatgtagatggagaatatggcttgcactcttggccaaaacaggttcacaaatgcccctctctggaatgatctagacctgggaagctgaatgggggcaggtggttgtgggtcaccctccaaggccactcctgcaggagacagagagcccaagaaccatgtggccatctgagtacattaactgcccaacggagaagtattgtccgatggacatcagatcttccctcttctgccaaatacatctctctccatgggaagagacaggtaaagatggaaggataggccaaagattttccctcaggagtgctaagccagcgaatattttgattttatggccctgggcagaaaggtgaaaagagggagaaatgatttcctttccaggactagaatctaagagcagttttgtactaacatgctacttaaaaggctgcttcaaagctaagactgcacatctgacctccatattcctagtgcctgctggcctatagtaggtggtcagtaactggatggatgggtaggtaggaggagccctttaagggactggctttattggcagaccagctttcttcactgccatctgtgccttgaaatgaccatttcttacccatgagcttcccccagtaaagggaaggaagaattcccttggtgttgacctgtctaatttacatccttcttccatgtctgaatctgtcttcccttgtacacctttttggttgggcagagctggaatatgtgtttgctctgagaatgaagagaacatggaggtagccgggcgcagtggctcacgcctataatcccagcactttgggaggccaaggtgggcagatcatttgaagccaggagttcaacaccagcctggctaacatgatgaactcctgtctctactaaaaatacaaaaattagctgggcgtggtggcaggtgccctgtaattccagctactcgtgaggctgagacaggagaattgcttgaacccaggaggcggaggttgcagtgagctgagatcgtgccactgcactgccagcctgggcaaaaaaaaaaaaaaaaaa

SEQ ID NO: 2407 - DNA, 2604 bp, Homo sapiens
  misc_feature (1286)..(1286): n equals a,t,g, or c
  misc_feature (1350)..(1350): n equals a,t,g, or c
  misc_feature (1369)..(1369): n equals a,t,g, or c
gagctaatcccctataaatgattaataattctttacattaacatttcctcttcaaattactgtgttctttctgtctcctgactttgactgatactaggacaggaagccgaagaaagaattagtgttctgcatgggaccaagctcacacatgaacatcacttctcatcagcctcctcatcacaattttatgcttcttttagatatcatttttgttctagcatggattttgatgttgcttacaaacatttcctgagtacatattgtgtatttgagaactaatcataacatctaaaagcagtgcaaaatgagcaacacacatacacgtgtatgtgcacacacacacacacacacacgactactcctattgggagttgagacaacaggcttcaacatcaactgtgtccttaactagcactgagaatatcagagagaaagccctctgagcttttctctttgaggcttgatgagataaattgaagatattttctgctcaaaaaatcgataatatttgatttgagtggtgtgaatgtcaaacagcaaaatgttagtgaaacaaaaggacagttttgaaggctagccatggattctggggctggtgagaggcaccgtgagagacatatggagtgaccattgagagcaagaaaagatgttctgggctggaagttgttctccttgtgccaaatgcaaggaaatctatgaaaaccctctcaccacatagaagaagccattcttttctttttttcttttttttttgagacggagtctcgctctgtcacctagggtggagtgcagtggcgcgatcttggctcacggcaacctccgcctcccaggttcatgccattctcctccttcagcctcctgagtagctgggactacaggcacccggcactgcgccaggctacttttttgtattttcagtagagatgggatttcaccatgtgagccagggtggtctcgatctcatgaccttgtgatctgcccgccttggcctcccaaaatgttgggattacaagcatgagccaccatgcctggccagaagaagccattcttaggcaactacataacagacatatttttcaaagcaggaaaagatacacagaaacacgtggaagcaaatgtaaaaccataaatctacatagacatggtagatttttattttaaagtctgaattttgggcatttgcagattgaacaactgggaactttttctattaacagtcctgcattctataataaacagaccaatgggaattaaattaggttagtattcaaaaaaaaggtcagcangtgataaagagccagggcagctgtcaaatgaaaagacttggcgcaggtaactattctggatagntaatgtccttagacctagngactcacttctaacaaagacactgcagcaaaagtgataggctatcatttctgagattaagtttaaaaaggtgttgacttccaccatcgcacacacacactctctctctctcgatcactgtcatgctcattctgatgaagtcagctgctgtgttgtaagctgttgtatgaagggacacgtgtgacaagaaactgagagtagcttctgtccacactcagcaagatttgaggccctcagtctactattatgcagcactgaatcttccttagatccttcttcactcaagccttgagatgagaccacagcctctgccgatatcttgattccaaccttgtgagacaccttgagggacagacaccaaactaagctgtgcccaggttcctgacccacagatactgtgggataacacatttgctgtttaagtaactaagttttgtcacacagcaatagatacataaaagatgctgggtgcagtggctcatgcctgtgatcccagcactttgggaggacgaggtgggcagatcacttcaggccaggagtttgagaccagcctggctgacaaggcaaaaccctgtctctacaaaaatacaaaaattagctgggcatggtggcacatgcctcccagctacttgggaggctaaggcacaagaatcacttgaacctgggagacggaggttgcagtgagccaagattgagccactgcactctagcctgggtggcagagtgaggcactgtctcaaaaataaataaataagtaagcaaataaataaataaagagtatcgttacaccggttttctgtggctgctgtaacaaactaccacaaagttggtgggttaaaaccacagaaatttattttttcatggttatggaggccagatgtccaaaatcagtatcactaggctgaaattacggtgttagcaggaccacactccctctgcaggttccccctgccagctgctgacattccttcgctcgtgataacatcattgtagccttcgtggatggcacttttaaatctctgtctacccccatcttcacatggccccttcctgtgtgtgtgtgtgtgtgtgtgtgtgtgtgtgatctccctctgcctccctctttttttttttttttttttttttggagacggagtctcgctctgtcgcccaggctggagtgctggagtgcagtggcgcgatctcagctcacccaagtccgcctcccagattcacgccattctcctgcctcagcct

SEQ ID NO: 2408 - DNA, 3033 bp, Homo sapiens
ggcacgagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtcaaaaaaaaaaaaaaaaa

SEQ ID NO: 2409 - DNA, 2003 bp, Homo sapiens
ggcacgagaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacttacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaaggcataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataaaaaaaaaaaaaaaaaa

SEQ ID NO: 2410 - DNA, 1417 bp, Homo sapiens
gaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacckggcttcaggagacttgggacagaatgctttttggcccaaatgcgggcacagaaagtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaaaaaaaaaaaaaaaaaactcgagg

SEQ ID NO: 2411 - DNA, 1146 bp, Homo sapiens
  misc_feature (1141)..(1141): n equals a,t,g, or c
gcaggaaatgacctgattcctttctaatacttgctccacggggtctggtcagtcttcacagcaccaggcagacaaagggcctggaagtagaggcaggaggtcccagatctaccgacctgccaagtcacagcctctctgggctgctggagaatctgtaagcaagaccgaattgtaaaagtaaagcacagcacagctttgagacccagaagccgttgctgtgaacttactgtttttgagctgcattctggagaattgcagctccaagtttattttacccattatgtatcaaagaagaccccatatagttaatgttgccatccgcccttggacccgggtctcatgtttagaccctggcatgggctgctgcctggcagtcgtctcgtgccctgggggcttgttagacttgtgggagctcccaatccgtgtgcacactgatgtgtgacagcttgactgtagaggscccagctgtgccctccccacagggcagaggccgacccagascccacactctctggacctcactcctgtactctccamcctgggatttcctgctcaaagggaccaagcctgcttccaggacctgtattggcctcttcccccaagccatggtgccccaaccccaagggatggccaaagagtgactgggggagttggcaaggggctgttgcgggtgtggggtggagcttggacgtgagggcttgaaggtccttgcttgtgtgcacgagactcctcacattgcaggatggagttgtggggagggtggaaagagaagagtacagacactgtcggctacaagcgttctcttttacttgtcctgggtcctaaaattgtcagagtggcctatgcgattttataaaataatttttctaggtctgtgggaatctacaattccactgttaaggtgagagagggataattagaaagttttcttagaggaggggcattggagctgggttttgacagatgcgtaggagttcagtagtagaaacagagggaattaaaactatgtaaacaaaaatatggcagaagggaagtgaggtatttgtgggaaaagatgtgctttttgctacagtctccacagtttgggatcagatcacgagggtcttgaattccagatggggggtttggtgggagggagccntcgag

SEQ ID NO: 2412 - DNA, 1465 bp, Homo sapiens
ggcacgagggcagattgcccattacaaattatagatttcttatttctttggaaaaatgaagtctgaagcaccaagtacattattacttggcaacaaccaactgcagttgggtagcagccttctcctttaaacccgcacccacctggcttcttaatttatgttcatagcctgtcttctgcagtcattatgtatttgactgttctacaatctccgcttctcgctaagggaggacacaatctttctaccaattagaaatatctagctagggcttacaaatttcataattgattttagtcctgtctgctgaactacatttttaaaagatagaggacaagatacacaatatattatagacttcagccacattttcttctttgcatctccactaattcctattattgattttcctttgagcacattggtttgtgcgcctgaattataagtagtgacaggttgaacttcctccactcctgtatgtgtcagagttgcaattaacaatcatgtaggtcagataatagtgatgacaatataaaggaaaaaatacttcctcctaacttagtctcggaggttttctgtagtgaatatgttcctttacctacaaagaatatttgctttcaaaataatttctaataaatgtcatatgtcaactcactttccatgtaactatttctatttctagaaatctgtttaaggtcaagaactaacattagttactcttcttttataagcctctgtcgatggcgttcataaattctacaggtcttactaactttcagaataagttagcaatattttgaaatccattatagataatctgaaagrttaacatgccttacatctgaccataaatttgatactaatataaaattctattcaatctttcaggcccacagtacatttttaacttgtttcagaaaaaaatctggcccaggccagagtatgtgagtcacttgagataccttcctttactgacagcttttaagttatataccctrcaatctctagtacaaacatgcccttcctaattattttccccttgcccctcacatgaacctccttttcccttccaagatatatctcatattacctctttgtgatgttcagacattccctagcatttgtattctcacccctttccagtctattcaaatcctacccaagtttcatggaccttctgaaatgcacgtcctccataaaattattcctgctcactctacctctctgattcaatcatctggcaaatatcatgtgctagattgaaatattatttatcttatcaagtcaatatgktttaatacctttagcaatatgcttacaaaaatgtcctatattccatgkgtttttwaatccaataaattacytttcataagaaaaactcwtaaatattcatcagtggctaacctagttctgagatctaatagcttaaatcaaagatccagtatcatcaaattttctctctctcgag

SEQ ID NO: 2413 - DNA, 1817 bp, Homo sapiens
  misc_feature (1796)..(1797): n equals a,t,g, or c
ggcacgagggattattacatgccgataaggtatgaattggagatgggatccaaaattactgtacttagtgtaatttttaagctaattacagggttggtggtgaatattttacttctgcaaaatgaaaacagcatttcatcagaagttgttttatggtctttcagacattttattgtatatctttggtgctttttgcccatgaagtatctcttttgtgtgtttgtgtgtatgtgtattgatctgctgtaaatttcacagcactcattgtcagggatcagcagaatcaggcctaggcagagagctgagcagtactctcagtacgtctctgtgtccttgttgccacattatctctgttgtttatttataagttggagaactctctgacctgtaacaaaggttggataggtcagagacaattgggagaggaatcctctgctctattgtcacctgtgcctcactccaaaatatgctctgaaatcaatatttaaatattaaatttgtatggtgaatgtatycttttttaawgttaattaaakgattggtcagcccacttaatatttacaatgcaggacttactttgcgtattctctgtcttgtatttttgctttatttaagctaggctagcctccaagctggaagctgaattgmcagttgaaaaataatgmcatgtatmcaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcamcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccrccyggccagccgccccktccgggaggtgaggggcgcctctgccyggcygcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaawaaaaaaaaaaaaaaaaaaaaaaaaaaatgtnnaaaaaaaaaaaaaagggggg

SEQ ID NO: 2414 - DNA, 1953 bp, Homo sapiens
  misc_feature (1362)..(1362): n equals a,t,g, or c
tttttttttttttttttttttttttttcaccaatgaaaacatttttttaaaattaacagacatcaactggtataaatacactgtctaaagcatttaatggtctttctttaacacagccaactcccccgggtttgaaacagtgttaaattctctcttgcttgtggcaaaagaagctgtcaagtccaacactgaaaaattggtaccatttcctggccagtaagcacagaacagaggggctaaatattttatggttttattyatttactgtgttctcatgctgtgtttttcttttctctgtctctccctcctgctcgtgtctgcccagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccacctccttccttcaagtacatactgaaaattcagtcargctgaatttattcagaatgctttaccgagctctttcattatttgcacaggaacaaaagagaacacggactcccgctccctacccagaataaaaggacacccagaagaaactcactcagggaggtggggggttgggggcgagggctggaagaacaatgcaggagggggtggcatctccttcagcttcagcagtgtgccgagaagagggctaatttgaggaacaggatggtggtgcggagccctgcctgagggccgaggcagaacttccccttttcttnggccttggcccgttacaaagaggggtgttgcagcagctgatgcaaactgagttcagtttccctggggagcagaaggactggtacccggcagaggcgatgagacaggccgctgatgatgcacaggacttgcggtacatgatcccggcactttgctccatcacttctttctgacacatgtcttgaacgttcaccgtgcaattcacaatgaactcgggggaggagcagtcgttgttcagctggaattcttcacactggtagcactggatttgcagcgcaaagcctggaagcaagaacaatccgcaaaaagttgccgcgatgcctaggacccacattctcccggagtcccggggccgggagagggcaagcgcatcagaggaggcgacagcagcggaggctgccccggctgcagcggctgtggctgccgaggctgctggggcccgcgctgctgccgcggagacgacggtcgtagcttagaggagccgcaggtgccgctcgcggagcctgcatcgcccgcgctcgggctcccggctgcgggtctctgctcctcccgctcgcgctcccgggccgagcaccgcgcctccggagttggcg

SEQ ID NO: 2415 - DNA, 1956 bp, Homo sapiens
  misc_feature (1362)..(1362): n equals a,t,g, or c
tttttttttttttttttttttttttttcaccaatgaaaacatttttttaaaattaacagacatcaactggtataaatacactgtctaaagcatttaatggtctttctttaacacagccaactcccccgggtttgaaacagtgttaaattctctcttgcttgtggcaaaagaagctgtcaagtccaacactgaaaaattggtaccatttcctggccagtaagcacagaacagaggggctaaatattttatggttttattyatttactgtgttctcatgctgtgtttttcttttctctgtctctccctcctgctcgtgtctgcccagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttgaatgtcaagcgagggagccttgagtgggaactggccctccagccctaagaaaacgtcactctcactctgcagtctcaaactatgcccccatcagggatggaatggacactggaggctttacaaaaggcagatgcccacctcagtgacttctaaggactgactctgccagcctggccttgactccggttacacagacatgggggtgaactttcactccacctccttccttcaagtacatactgaaaattcagtcargctgaatttattcagaatgctttaccgagctctttcattatttgcacaggaacaaaagagaacacggactcccgctccctacccagaataaaaggacacccagaagaaactcactcagggaggtggggggttgggggcgagggctggaagaacaatgcaggagggggtggcatctccttcagcttcagcagtgtgccgagaagagggctaatttgaggaacaggatggtggtgcggagccctgcctgagggccgaggcagaacttccccttttcttnggccttggcccgttacaaagaggggtgttgcagcagctgatgcaaactgagttcagtttccctggggagcagaaggactggtacccggcagaggcgatgagacaggccgctgatgatgcacaggacttgcggtacatgatcccggcactttgctccatcacttctttctgacacatgtcttgaacgttcaccgtgcaattcacaatgaactcgggggaggagcagtcgttgttcagctggaattcttcacactggtagcactggatttgcagcgcaaagcctggaagcaagaacaatccgcaaaaagttgccgcgatgcctaggacccacattctcccggagtcccggggccgggagagggcaagcgcatcagaggaggcgacagcagcggaggctgccccggctgcagcggctgtggctgccgaggctgctggggcccgcgctgctgccgcggagacgacggtcgtagcttagaggagccgcaggtgccgctcgcggagcctgcatcgcccgcgctcgggctcccggctgcgggtctctgctcctcccgctcgcgctcccgggccgagcaccgcgcctccggacggcacgagc

SEQ ID NO: 2416 - DNA, 4161 bp, Homo sapiens
atagatttttgtctttcaataaaactttttactttttctctatatttcaactaaatgtcttcaatatgccctatttttgtgctattgcaaatgatatcctttatgacacttattgctttggaatagaaattataaattgatcttctattcaccagtgttattcaactagtattaattcttgttgtttttctgttgccatcctcaagtaatggcagtttattactttttccctaatttcttattaatacaatcttgtaccagcaagagtctcatagccaatgctggattatgtagtgatgatgtctgttttgatcctgatttaaaagcaatgtttctgagaactcttctttacatgtatttagccattgattttggatagtctttatcagattcacttttgtttctgtatctcattttctaagactaattatgaataggttttgatttttaaaacaaataaattgaaaatatctattgagatatttttctgctttaatctgctaatgtggtcaattgtgtcgatattcttatctctaaaacattttgtattcattggacaaatcttagtcatgatgtatttttaaaataaatcaatagatacttttgccaaaactggtttaaaatttttgattccatgttcatgcataaaatcatttggtgattattccccatttttcttttctctgagagagtttgtataaagatagaattatatgttttccaaaattttagtagaacatctccagtatctccccttctcgcagaactcttaaccctattttttaaatcctatgtcgtactaagagagtatagatgtgtgcttctggaactaacatttcccttgaaggatatttccactgttttattaatcctttgtttcttctattatatacatctttttttcaaaaccacatatattatcatttctgatagtctgttattatctccactaccttattttgcttaccttgctgtaacagaatacatgagactgtgtatttataaaagaaacaagtttatttggctcatggttgtggaaactgggcagtcttaagagtatggctgtagcctctggtgagggtttgaattacatcataacatggcagaggagaagagaaagcaggcagatgcgaaaggggcaccaatgaggtagttaatccagtcctgagagaatgagaactcactcccaccagaactaacccaatctcctaagagtagcattcattccttgtaaccacctaatcaccttttaaaggccttgtctcccaagcaccaccacaccaatgaccaaatttttaacaccaaggattctgggtaataactcaaaccacagcattcattctgccttccctttattctatcttaagatctaatttgtttggttatttatttattggggggagcaataaagacatttcttaaatatttcccttccatcaaactcatcctaatttcaagtagtgccagaatgtctctgggattgggagaatcaggccaagaggaagttgagttgggtacatgtagtttgggattaataggatacaattaattagcttaaacagtcaatttcatttaagttatgttattgctacacaccctggtgtatgactagccccccagtatactgctaccagtgattgtgcccatctactcatcattgtaagtcaaaggtgcgagttcacaagttattctatgaagtgaatgttcccttcagcaactggcactgggggcatgttagcagtgagagaaaagcaatatttaaaagcacagagcaagaaattgatctgttagaaattattcccatcattaggtaggtaaaattataattaaatgtctttgtttctcctgaatacctaggaaaaaatgaagagttgttttcccagaattatagaagtatatccagtaaagcaattatagatacaccatacttttttactgttgggaattacacaaaatagagttgactaatctctgtgctttagtgcacagatctgtagtgagactagaaagagtcatacatttgcatgagaatatgtgtgttgaatgtaccccaacgtatgagattgtattttagcaagtgacatattttgtcttgttgaagtctaattgtcccgaacagagtggatttctagaatgccacccacatagtaaactggcctaaagataaatgatttctagtgaccaaaatctaatgtataccaattagtgagtcaatgtgaaaaaggagtaacttgattatacaatctgcagttattagaatgtagaagcaatttcaaaatgcacttaaattgcctgtgtatgtgttaatttcaggttaaatttgtatgtgactttttcataattattcatcataccaaaatgcgaatgtaatagaaagccaagaatttactccagaaaagaaaccttgtacctttaaaatatcaaatcattctagtttttcacaatgagtgctagttatccacaacttttgatgctgtaagaaactcaaacttaggtttccattccaagatggctgaataggaccagctccagtctgcagctcccagcgtgatcgatgcagaagacaggtgatttctgcatttacaactgaggtacctggttcatttcactgggactggttggacagtgggtgcagcccacggagggcaagccaaagcagggcggggcattgcctcacctgagaaatgcaaggggtcaagggatttccctttcctagccaagggaagctgtgacagactacctggaagaacgggacactcacgcccaaatactgcacttttcccacagtcttagcaactggcagaccaggagattttctcccatgcctggttcggcaggtccaatgcccacagagccttgctcactgctactgcagaagtctgagatttaccagcaaggctgcagcctgtctaggggaggggcatccaccattgctgaggcttgagtaggtaaacaaagtggccgggaagcttgaactggggcagagcccactgcagctcaacaaggcctactgcctctatagacaccacctctgtgggcagggcatacctgaacaaaaggcagcagaaacttctgcagacttaaacgtccctgtctgacagctctgaagagagcagtggttctcccagcatggtgtctgagctctgagaacagacagactggctcctcaattgggtccctgacccctgtgtagcctaactgggagacacctcccagtaggggccgacagacacctcatacaggtgggtgcccctctgggatgaagcttccagaggaaggatcaggcagcaatatttgctgttctgcaatatttgctgttctgcagccaccactggtgatacccatgcaaacagggtatggagtggacctccagcaaactccaacagatctgcagctgagggactgactattagaaggaaaactacaacagaaaggaatagcatcaacatcaatgaaaaggacatctacaccaaaaccccatctgtaggtcaccagcatcaaagatcaaaggtagataaaaccacaaagatggggagaaaccagagcagaaaagctgaaaattctaaaaaccagagtgcctcttctcctccaaaggatcacagctccttgccagcaaaggaacaaagctagagggagaatgactttgatgagttgacagaagtaggcttcagaaggttggtaataccaaacttctcctagctaaagaagcatgttctaacccattacaaggaagctaaaaaccttgaaaaaaggttagatgaatggctaactagaataaacagtgtagagaagaccttaaatgacctgatggagctgaaaaccatggcaagagaacttcatgatgcatgcacaagcttcaatagctgatttgatcaagtggaagaaagagtatcagtgattgaatatcaaattaatgaaataaagtgagaagacaagtttagaaaaaaaaagggtaaaaagaaacaaacaaagcctccaagaaatatgggactatgtgaaaagacaaaatctacgtttgattggtgtacctgaaagcaatggggagaatggaaccaagttgaaaaacagtcttcaggatatcatccaggggaacttccccaacctagcaaggcaggccaacattcaaattcaggaaacacagagaacaccacgaaggtactc

SEQ ID NO: 2417 - DNA, 1211 bp, Homo sapiens
gaattcggcacgaggtgagctgacaccactccactgcactccagtctgggcgacagagtgagactccatctcaaaaaaataattaatatatgtgtgtatatgcatacatatatacttgtgtgtatatgcatacatatatacttgtgtgtatatgcatacatatatacttgtatgtgtatgtacatatgcatacatatatacttgtatgtgtatgtacatatgcatacatacatatatacacacacgtacacacatgcatatttcttctctcaacttggcaagggcaggatttgcagattataacctagatctcattcatgctgcattttttcactcaccctattgttctagttttcttggattccaacctgggcttatctccaatctgcatttttttttgtttctcctccctagctgaatatatttgtggaaaactcacaaagcaactgggttgccaggtctggtctctatcttcctgtccagtgaaaagaaaatgacatttagaaaacctagtcacaaatgtctgtttaataaattttgtttgttgccctgaaactggattttaatatttctgaatattcagtgcctggaagctagcacaaaatggctatctaaaactgccagaaatttgctttatgtggttcttaatgtgaaactggaaatgcaccttctggatggtgtcacttcttttgagagggatcgctttggtggggtattatggttgtgtctacttatattaagtaactactcactgcccctgaggtgtctcaggacttgggataaataatctaaaagcaaatactttataatggaatatcatgtattctgtttaataatataaaagtgtgtcccaacatattcagtgaggaacatctctgtagaattattttttttctttaacgaagtgtttagtattttctctggcagacctggacacagggtttgagcctagtaggttgagtctgagactgacggatcaaacagatgagagaaaggacttatactggaggataataggctttgaaggttcaaatctttaattagacagtctagtgtttgggatgtatttccaggggtaggggggcctaccattgagacattagttagcttactaatgtccttgggcacgctctatgcacgagtcagccaaattgttgtttgaaatttctgctgtagctctgtagaaaactgaggggcaatgcattttccat

SEQ ID NO: 2418 - DNA, 1703 bp, Homo sapiens
ggcacgaggaaagttaagcaactacaggaaatggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactagactcgaaaataatgaaagttgggatcacaatgaaatgagaagataaaattcagcgttggcctttagactttgccatccttaaggagtgatggaagccaagtgaacaagcctcagtgacacaagtcaaattcatagtttcactctgggttttttgttgttgtgtggttattattctcactacagaaagactgagtttcatgctcctggctatgtcagatgtgaattttcatgggaataataatcaaccttgcagcaagccaaagcaatgcctcgcttgggttcttcatgttcttactacccagcgttttttaccacctagatgggcctctctaagtctatttgctcaatgaaccttatcccaaacttgttgttttcatggtgtctgaaagaatgtgagtcagcttttagaatgaaatcagtgttaaggtacctccagtgaaccaaacatgtgtttaaattaagccactgaaaacagaagggaatgtccaaggcaaatacaaatcatacacagcttgtaacaacatacagccttttatgtgaaataatggaataaactaaagagtttctgaagactgaagctatctggatatcaagtctggagtaggcaaagcatttccatttctacatggattataaaactttgtgttggactccattggtccctaatgcttttgttcatcacttctccagttatcaatggaattacctggtgaccattcatttggaccgaaatcctggaagtctcctactgaataaaagtctacaattggccctaaaatagaaactgaaaaacaggacatagaattttttcaccagaccacagcatgtggaaactttctttatcatttttgaacacttgttaacagatttgcacatagagggagagaaaaaaaatggagtaacagtcaaaataataataatcagtatccaggccaggcgtggtggttcacgcctgtaatcctagcactttgggaggccgaggcggatggagcacctgaggtcaggagtttgagaccagcctggccaacatggtgaaaccctgtctctactaaaaatacaaaaattagctgggcgtggtggtgcatgcctgtaatcccagctactccagaggctgacacaggacaatcacttgaacccaggaggcagaggttgtagtgagccgagatggcaaccctgcactccaacctgggtgacaagagcgaaactccatctcaaaaaaaaaaaaaaaaaaaaaaa

SEQ ID NO: 2419 - DNA, 3121 bp, Homo sapiens
cggcacgagctcgtgccgcttcaactttcttctgaggaatggatgattctagagttttcccagctgggcttcattggtaagaaaagtgtcacacttacctacttttcataaataactgtgactctcagaatctaaaaccaagtagctacttgtcctaaagatgtctttttttcctatggaaatgggttgttttagagaaaacttaagttaggtaaacctctttgtatgacatgatgaaagtcaacccagaatagaatttggagacttctaagattattgtatttactgtagcgttcttcacaatgccaaccgtggtgctggtgagcatgtttgattttttcttctctggcatttccagctcctttgttaacataagattgcagttcttttaaaaacaataccacaaagagttttctcatataaattcctagtattttcatgcaatgcatgaagtcctaattcagtgattaatttttattcgtttttctcttaactagttggggcactcatttctaaatggtttttggctgatgtttcaaaattagccagcttaagaatatgtttaaagttagccaggcgcagtggctcacgcctgtaatcccagcactttgggaggccgaggcgggtggatcacctgagctcagaagttcaagaccagtctggccaacatggtgaaaccctgtctctactaaaaatacaaaaattagcctggcatggtggcagacgcctgtaatcctagctccccgggaggctgaggcaagataattgcttgaacgggggaggtggaggttgtagtgagctgagatcgcgcccctgcattccagccttggggacgagagtgagactcaatctaaaaaaaaaaaagagtatgtttaaagttgaagaattgaaggaaatttacagggttcaaataatattgagaggttaacatttcatctcctatggtactttttaacactttaagcatttagaggctggacctttgacaatcttgatcatttaactcaaaacttaaaagtcaaaaaccatctttacttgcaaatgctttagtgaaaacaaaattaggagtccttattttttgcatttattgattcagataaaattttttacctaaacctctcaatgttaaatgggaagaatcttagtaagacacgaagggaaaatctctgacttgctttttgaatgctttgggccagtaggtatacgatagattattatagtaacatcgggaatttactatatctgtttacacccaggtgacagctcaagagaaagtttagccgaagcaactttgtttaattttgataatacaagtggggaaattgtttatgatgatttatagttgaaagcgcaagcctcagtgtatgtcgtgggcaagatttcatgaatgtaagccattttggtgcttggtttcttcattgcagctattgactgggaatatcttttcaggtaaaatgtttcaagcgccggatcttactctgattgtagaattcatattcatgttttacaaggagaaacccattgattggctcctggaccatattctctgggtgaaagtctgcaaccctgaaaaagatgcagtaagttaattcctcaccagagtggagggagtttcacttctgtatttcgtgaaagtgacttttagagattttgcaaataaatagttaaataggtaggtgatataaaacttctttcctgagctgataaaaagtttctatattagaagaacttttagatagcagtggaagatcctgtaaagcaggaagctgttacaagatgacgtacattctttaaattgctgataaatgtttctagtgtttgtaagccctggtggtttactaacattggatgtagatgttggtcatatctgttcttggcatgggataccatttcagtttgttttcttcatatttcctgttcactctctttttccttgtatactggggacgatattagaccctaacacatctgtaaatgaggaataaaatagaagtaatattttataccaaaacaatgagacgttaaagtacctttcagcgtgttacaaaaagccagtgttcataataatatgattacctttgggataatagttgcagtcaagtaagtgaataataatttttgctttgatcattcagatagcatgttattaccatagagatcttattgttaagagtaattaggccaggtacagtggttcacgcctgtaatcccagcaccttgggagcccaagactggaggatcacttgagcccagaagttcaggacaagcctgggcaacatatcaagacccatctttacaaaaaaacaatgatttttttttaaaaagagtaattaggtatgttttccttgtccaatttgaattgtgtctctgaaaaaaaactatagcttttaatttatttgatgtaagcataaacaatatgtaaaagtacaaattctttaaaatgtccattttgatgtgtaatgataagtattactgtaagaacatgtcattatagagttgacttaccattcattgtaacaaataagcattagtttgacttcatgaccttctactccctagaatagttggatcctcatacctgctaggttttaggatactaccttctggtgtctgtaggctatcattgcattctgtttaaaaaaaaccacaaaaattttaaaaaaccccaacacattcttagttagaggaaatcatggaatctagcaatggcagagtatctgttttccgacaattagttgaacatataaattgttttaaacaaatcattttttagagatctcagtccttatgcacattttcactgtgacttatagaaatttttattgtaggacacagaaaaagttaacgtcatctttaacctcctacaatacacttgcattccattcgtcctgtgcaattttatttaatatgtggttaggttctaaaatgagcctgtgaggtgaaaacatctatagtagaaattaaaaccacaaaaaccctctaaatcctccataaatttgggtacatgaacttttggacgatttcatccattccttcactcttctgtagtccatgtttttgtgtggcctctaattcttcagttgcttcccctagaatctcgagggggggcccggtacccaat

SEQ ID NO: 2420 - DNA, 1501 bp, Homo sapiens
gcagtcagggctctggccagccctcatggttcaattacataaaacagcaaatggcatttcctgttgtccaaattattacataccgtactaaaaacactaatttttacattatatcttttccactctttagaccccaaccaataattatctcaatcacattttaactaaagaggggaaaaggcacatggttactcatgcagttggtttatgtgttgtggttattaataatcaaagtcaccaaaggcaaagtggaaaaaataacagctatgcaatcaagaacagagaaagaagcaagctcaatatagtttccaataaaccttaaaattgggctttgcaaatattaacaaaatatgagaactaaatgatgtgattgtttgtctcttttttatctaaagtggaccagagaaagttttgtgcagcgcagcaagacttcttcatcctgattgaatacagggtcacacaacccagaactcatttctgtgtatgatttctctttaagtgtcttgccctgtaaccctccctctcccagatattttagttgcaaattgagctcttttctaaaattgacaaaaataaaatattaataaactttcaactactggaactataaagaaaaagcatgacgtgtgatattggtggaaggtagagctcattcctcaggcatccatcatggtgccaggcttttcaacagcctgaatgcagaattcttagatcatttcaaacttacaatcttggcaatgacatgacagctggtgcacgtggcatattaattcagcaaacatcaatgccaactgtgtgccccatggatcaactcaccaccttttcttcaacaaagcagcagctgtctggtttttaaatgcttagttacaggggaaaggggtaatattagacatacttatggaagcataaaatcatgtatataagcacgaattgatgtgaccatcgtgatggaataaatttgcataatcaaatcattccgaacaattatttaactctttactagttaacttttagtccttacagtttgaaaatgtaattataaacaaaatctcctcctaacccrgaaatgttcacaaaagtggaagaaacagaaagctatttttattgcataagcattaaattagaattcaatgcacatcacatgcattttgctaagagattacaaagcagaaagaaatcttaccaagcagaaacaaatcattacatacatgctctcaagacaaactataactagtcctcatgtaagaggacatgatggcacagtttgtcacacrgaattcattctaaattcatttggtaattgggtgaccatcttgttagctaattgactttatccaaaggaaaaataaatttctaatatctttatcacaggaggcagttttgcaacttggagcaaggcatctaccaaagataagcttctcccctcccactgaaactggtagatagggatgctgtcttccttaatgattgcatttcaaagaaatagttcccaggtcctcga

SEQ ID NO: 2421 - DNA, 2203 bp, Homo sapiens
gtttctgcctctccccactagaaggtaagctcaatgaatgcagtgaccttgcctattttgttcacttttgtaagtccagtacctatagtggtgcatggggcagagtggccattcaataaatatttgctaaataaatgaacagtttgagtataaatcctataaagcatatccagctacttgaggaggagatataaagcagtgactgtagagccctccatttaactacaaacaaaagcaaagctactgttcatcaaggatcaattttgaaattcccagccagctttttttttttgtcatatgcaagtgacgataattaatggcttaaagtagggtgctatagcaggaagggaatgaataaaatgtactaaggctcctatacacgatcagattatagctattatggatattaatatatgtatactatacgtactcttagacgagatcgggcgcattcagggtggtatggccgtagacattatatatacttttaaaatgaaaacaaaaagctaataaaataattatggtcccagaatctctttaaaggccaggcctggtggttcatgcctgtaatctcaacactttgggaggccaaggtggaaggatcccctgagcctgggagtttgagaccaggctaggcaacagagtgagcccttgtctttacaaaaaaatttaaaaataagctggttatggtggcatgtgcctgtggtcctagccacttgggaggctgcggtgggagatttccttgagcccaggaggttaaggtgcagtgaactgtgattgcaccactgcacttcagccttagcaatagagatctgtctcaaaggaaaaaaaacataaccctttaaggataagattccatggatataggcagattaattgggacagaaccaataaaattctagattcttactagagtatcataaacctacaagtattccctcaacaacatggcacacatgtaataaatcactattgataatggaaaccgcaaatattttaatttttctgctacactattagtgagttattgctgctttgtccttcacacattaattatctgctggtgtaacactctgaatccagctactatgtaaccttcactcaatgatgtaaaatctcatgattgtttttgtgttttcaggatgtttccctacccagaacacaatttttgtagaagaaagaaaatgatctgcttatttactttaatatggagatagtttggtttacaaagcaagtgataacatacttccccatgatcttttacattttcacaatagttatagtcctttgatttctatttgtatttcacattggtcttgtccccattgttatactataaatgccttaaaaacagagactaacccacttattctttaatttcccaggtcaagtgaaatgtggctggtacaaagtaagcatttaacaaatattttcaaatctgaattaaatatatcattcattcaaaaaacattaaaaagttatggctaggtgtggtggctcagggctgtaatcccagcactttgggaggctgaggcaggaggatcgcttgagcccaggagtttgagaccagactcgccaacatggcaaaaccctgtctctacaaaaaatacaaaaattagccgagcatggtggtgtgcacctgtagtctcagctgctcaggaagctgaggtgggaggatcctcctccgggaggtggaggctacagtgagccaagactataccactgcactccagcctgggtgacaagagtgagaacctgtgtctaagaaaaaaaaagttattattatgctattcatcaaggttatcatcatgaaggttatgagcctggtatttagaaagattatactccagtagggaaaactgatatccatatactaccatgtgttaagggatataatagaaggatgcccatagtatcagtcatgtagccttgatgaattcagcctggaccagagatgacatcaagacccctgtgctgagttttgaggagtcaagagttaatcaggcagagtaaaagaggcagtggatggtgagaaagttctaggataaggaaatatatgtcagaggaggtaatattttaagaactaggagattaactggatgtgggtgaaggaattgggaaaagagtagacaactcctagatttataatttgagcaattaactggtagtagacgatggctattaactaaaaaaaaaaaaaaaa

SEQ ID NO: 2422 - DNA, 2971 bp, Homo sapiens
ggaattcggcacgagctggttatagtttttaataaagaaagatcctcagaatgaaaaatagagttataataaacttatctaaaataatctacctttgggttcctttttgccttggggcctcttgtcttaggtcaagaacctgagagtccccaggctctgtccggggtcctcagagggaccatacctgttcacactgttggactctgcacacagttgtgttaagcagtgaattctgtggctttaagaagtctttgaaaatcactaacctggtgacggcctgtgccactgtcatcatcgaaatcagagtgtgtctcctgtgagctttattgtacatacagcgtacagggccaggcttgagaaagacagatctgctatactcatctcccctgcagaggacaccatggaatccgcattctccaaggccacatgttctgcccagtgcctcctgtcaccatgactgtaaccatctttcctctttttacctgtttgtttgaatgtagatttcatttgtgttgtatatgttcttatgcaggaaatattacctcctggttctcacacaggcttttctggattacatttgccattcattggttttacattcacaacggaaaggtatgtctggatttatcattccccagggagacacttcccctgtggtagatgaacagtcagacaccacagtctgtccctgggggcgggctagtgggtggtgtgtgcgctgggaggccattacttaagggagatggagatgggtttttggtcttaaaatatgcacacctgatgactacaggggataccatagcaaggttgcaggctttttctctacagatatccaggtcgtaaagaattcaggtttcatggcctttgttgtatgttcttctttttacaaccctttaaaaatgttaaaaccattcatgctcgtgatggtgcagaaacaggcctcgggcaggatttctcccagaggccaggggggtgagatttctcccagaggccgtagtttgccaacccctgaccaataggccgccagcattggcagggttagctctgatccagtcggtggccacagcaagcagagcagttgccatgcgcactcagctgagagctggcttccatcagagcactctgctggcttttgtaaggattgtgtgttgtgggcccctgtcccaaatgggcctctttgcaaagttgtgtcgcctgagatggtccacctcgattttaaaaggaaactggggccaagaggagaggggttaggaagaaagagaggtgaaatgagacaatggaagctcccactgtgccacagaatctgattcctggcgtcctctggcagctggaaccacagttgaaaatgtcttgggagggagatatccccatgcttctttttttttttttttttttttggagacggagtctcgctctgtcgcccaggctggagtgcagaggcacgatctcagcttactgcaacttctgcctcccgggttcaagcgattcccctgccgcagcctcctgagtagctgggactacaggcgcccgccaccacgcccgactaattttttttattttagtagagagagggtttcaccatattggccagatggtctcgatctcctgacctcgtgatctccccgcctcggcctcccaaagtgtcaggattacaggcgtgagccaccgcgcccggctgatatccccatacttctgctcgagcttggaagaaatctcttttggtgtgagaggccagggttaaacagcccataagccaaagtggcagctgctgtcttccagcccacaggaggctttctgggtgggcatattgatttaccagcccccagtgcagaggttcttgatctttctaatacatgccagctcaccaaatgcttgtcacacttgcaggtcccaagcccatggctgtagtttggccagataggcctagagctctcctcttgcagatcccgcagggctggagcagcccagcaccctcagaccacctgtgaagaaacactgaccaggtcttctctaaagggggctgggtgccctttatggaactctgcgtaggagctcaaaatttccctgacttcattgtcacataaagagctaagcagaactaagtaactcctaaagcagcccaagaattaagctattaaatgagagccatcctgggcttcagcctgtgcctcggctgtgtgcgtcatcgagtggtctggtccttggtaaggggcttagtgtgctggtcagtgctagaattggtggcttagcctgcaggggaagaagagttgaaagagctgtcctggattgcttggccagttggtggccaaaccaggaagctttcagtggtccatgcgtaccgctgacctgcagacgagctggggctgccccctaagccttgctttacgcaggatccatgccttctggttttgcatttatagttaagtgtgggggatgatttagaaatgccatttcccctcctttgcagaggcgctttctttgaccagcgatggggagggcccttgtcagtgtctccttgaccatctggtcacttgtctaactttggttccataaccataaagtcttatcccaggtgtttttgtttgctgatttaaaaagactatctttcacctcaggaagattgaaaatgctaatgaaatcgctaaattttcagtagatcaaaaaaacctgttgcttggtttcccagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaaaaaaaaaaaaaaactcgagggggggcccggtacccaatt

SEQ ID NO: 2423 - DNA, 5065 bp, Homo sapiens
  misc_feature (2531)..(2531): n equals a,t,g, or c
  misc_feature (5063)..(5063): n equals a,t,g, or c
tttttttttttttctttttctatgggttattttttattwtttttawttttatttwttattatactttaagttttagggtacatgtgcacaatgtgcaggttagttacatatgtatacatgtgccatgctggtgygctgcacccaytaactcgtcatytagcattaggtatatctccyaatgctatccctcccccctccccccaccccacaacagtccccagwgtgtgatgttccccttcctgtgtccatgtgwtctcattgttcaattcccacctatgagtgagaayatgcggtgtttggttttttgtycttgcgatagtttrctgagaatgatgrtttccaryttcatccatgtccctacaaaggacatgaactcatcattttttatggctgcatagtattccatggtgtatatgtgccacattttcttaatccagtctatcattgttggacatttgggttggttccaagtctttgctattgtgaatartgccgcaataaacatacgtgtgcatgtgtctttatagcagcatgatttatartcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatygccattctaactggtgtgagatggtatctcattgtggttttgatttgcatttctctgatggccagtgatgatgagcattttttcatgtgtyttttggctgcataaatgtcttcttttgagaagtgtctgttcatatccttygcccactttttgatggggttgtttgtttttttcttgtaaatttgtttgagttcwttgtagattctggatattagccctttgtcagatgagtagrttgcaaaaattttctcccattytgtaggttgcctgttcactctgatggtagtttcttttgctgtgcagaagctctttagtttaattagatcccatttgtcaattttggcttttgttgccattgcttttggtgttttagwcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattkcttgtttttstcaggtttgtcaaagatcagatrgttgtagatrtgyggyrttatttctgagggctctgttctgttccattgrtctatatctctgttttggtaccagtaccatgctgttttggttactgtagccttgtagtatagtttgaagtcaggtagyrtgatgcctccagctttgttcttttggcttaggattgacttggcratgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcmttgagcagtggtttgtagttctccttgaagaggtccttcacatcccttgtaagttggattcctaggtattttattctctttgaagcaattgtgaatgggagttcactcatgatttggctctctgtttgtctgttrttggtgtataagaatgcttgtgatttttgcacattgattttgtatcctgagactttgctgaagttgcttatcagcttaaggagattttgggctgagacratggggttttctagatatacaatcatgtcrtctgcaaacagggacaatttgacttcctcttttcctaattgaataccctttatttccttctcctgcctrattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatrttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttkgttgtgtctctgccnggctttggtatcaggatgatgctggcctcataaaatgagttagggaggattccctctttttctattgattggaatagtttcagaaggaatggtaccagytcctccttgtacctctggtagaattcggctgtgaatccatctggtcctggactytttttggttggtaagctattrattattgccwcaatttcagakcctgttattggtctattcagagattcaacttcttcctggtttagtcttgggagrgtgtatgtgtcgaggaatttatccatttcttctagattttctagtttatttgcrtagaggtgtttgtagtattctctgatggtagtttgtatttctgtgggatcggtggtgatatcccctttatcattttttattgcgtctatttgattcttctctcttttyttctttattagtcttgctagcggtctatcaattttgttgatcytttcaaaaaaccagctcctggattcattrattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgygtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagwttcttaatcctgagttctagtttgattgcactgtggtctgagagayagtttgttataatttctgttcttttacatttgctgaggagagctttacttccaastatgtggtcaattttggaataggtgtggtgtggtgctgaaaaaaatgtatattctgttgatttggggtggagagttctgtagatgtctattaggtccgcttggtgcagagctgagttcaattcctgggtatccttgttractttctgtctcgttgatctgtctaatgttgacagtggggtgttaaagtctcccattattawtgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccytttattttgagcctatgtgtgtctctgcacgtgagatgggtttcctgaatacagcacactgatgggtcttgactctttatccaatttgccagtctgtgtcttttaattggagcatttagyccatttacatttaaagttaatattgttatgtgtgaatttgatcctgtcattatgatgttagctggttattttgctcgttagttgatgcagtttcttcctagyctcgatggtctttacawtttggcatgwttttgcagyggctggtaccggttgttcctttccatgtttagygcttccttcaggagctcttttagggcaggcctggtggtgacaaaatctctcagcatttgcttgtctgtaaagkattttatttctccttcacttatgaagcttagtttggctggatatgaaattctgggttgaaaattcttttctttaagaatgttgaatattggcccccactctcttctggcttgtagrgtttctgccgagagatccgctgttagtctgatgggcttccctttgwgggtaacccgacctttctctctggctgcccttaacattttttccttcatttcaactttggtgaatctgacaattatgtgtcttggagttgctcttctcgaggagtatctttgtggcgttctctgtatttcctgaatctgaaygttggcctgccttgctagattggggaagttctcctggataatatcctgcagagtgttttccaacttggttccattctccccrtcactttcaggtacaccaatcagacgtagatttggtcttttcacatagtcccatatttcttggaggctttgytcatttctttttattcttttttctctaaacttcccttctcgcttcatttcattcatttcatcttccatygctgataccctttcttccagttgatcgcatcggctcctgaggcttctgcattcttcacgtagttctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaaaaancc

SEQ ID NO: 2424 - DNA, 1592 bp, Homo sapiens
taaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgt

SEQ ID NO: 2425 - DNA, 270 bp, Homo sapiens
ggcacgagcatacgctggacgagtcggaccgaggctaggacgtggccggcgctctccagccctgcagcagaagaacttcccgtgcgcgcggatcctcgctcgttgcacgggcgccttaagttattggactatctaatatctatgtatttatttcgctggttctttgtagtcacatattttatagtcttaatatcttgtttttgcatcactgtgcccattgcaaataaatcacttggccagtttgcttttctaaaaaaaaaaaaaaaaaaa

SEQ ID NO: 2426 - DNA, 1045 bp, Homo sapiens
ggcacgagccttggttgcattagacctctagcaatcgaaggccagttccagcctggaccaaggcctgcctctggttctgcacaatggcaagtcctattaggaggactaggagctttgtccttgaagtaaagacctgcatggtaactggtttcagttaggttggctcactgggatttgaagctgggatgaatggattccacactgacctttatcccatgggcctgttggactggctcttggggaactcataactgtaccatgtgtttgagcttcagtgagctcaaatgcagagtcaagtgggaagagatgcaagattgctaagtaggtggtcagctatctgccaggggtcttctcctaatggtagaccagctagcctgtcaatctgaagtctgcttttgtaaagctttgtgctgggggctatgatggatagtaataaaatgacattgtcctctcagagcttaggatctgccaaattaggaagcgtgttcaaagaaacccctagagagcctgagatgagttaagggtgaggttctaaccaaaccaggtgtagctttagcggtacaacctctgtaaatcactcaacttgtctgtaagtcagtttgctcatgtgtgaaatgatctcaaaaattccctctgcctctggctttataatctaggtggaaagatgaagcataaacacagtccatttgtagtttcccgggcctctgataacatctccaatctgagttacttaagctttagagccacctgttagcagcattcaaagcaagattgttgaggttggtgacaggtgcactgcacagttgtgccctgtgggtgctctgtggccatgaggtgagccagaaagacaaactgcacatgagtaggccaaccgctctgcagaacgtgcagaaaggttcattgttcatggtcagaaaataacattttgtattgtggtaaaaagagaaataacattctgtctcctattgtcacaatttataatgtaagattttaaagatgtaataaaaagttatgcacatcaataatgaaaaaaaaaaaaaaaaaa

SEQ ID NO: 2427 - DNA, 838 bp, Homo sapiens
ggcacgacttagccttagtgaagaattgaaaatgcattatccagatttccctgatgtgagttctggggtttatgtatgtaaagtggttgaaggaacagctgctcaaagctctggattgagagatcacgatgtaattgtcaacataaatgggaaacctattactactacaactgatgttgttaaagctcttgacagtgattccctttccatggctgttcttcggggaaaagataatttgctcctgacagtcatacctgaaacaatcaattaaatatcttgttttaaagtgggattatctaaaaaaaaaaaaaccagttatatcacgtggtttgtattggagatgtgccaaacatggcaagaagtttttggatctttttcttacaaagaaaaatggatggttatcaacccaaatgcccatcaatgacagactggataaagcaaatgtggtacatatacaccatggaatactatgcagccataaaagcaacagtcctctgcagggacatggatggagctggaaaccattatcctcagcaaactaacgcaggaacagaaaaccaaatactgcatgttctcacttataagtgggagctgaacaatgagaacacatgaacatagggaggggaacaacacacactggggcctggcagtgggtagggtagagggagggagagcattagcaaaatagctaatgcatgctgggcttaacacccaggtgatgggttgattgataggtgcagcaaaccatcatggcacacatttacctatgaaacaaacctgcacatcctgcatatgtacctcagaacttaaaaataaaaataaaaaaaaaaaaaaaaaa

SEQ ID NO: 2428 - DNA, 1367 bp, Homo sapiens
gcattgacctacatggttcagagaacaccccacgggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttyggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataaaaaaaaaaaaaaaaaaaaaaaaaaaaaaaaaaaa

SEQ ID NO: 2429 - DNA, 915 bp, Homo sapiens
ggcacgaggctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgtcttgtccctctgctgcattggaacatccgcagatagaagttttagaaagttctatttttccaaaccaggattccttactattgacagattttctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctaccaaatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcatggaaaagtatctgtaattaaagtttcgaagtaatttaaaaaaaaaaaaaaaaa

SEQ ID NO: 2430 - DNA, 2509 bp, Homo sapiens
gttccgctgcagcctactccgccccgtttgcggtaccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactrgagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacrttggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgayctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaaaaaaaaaaaaaaaaaaactcgag

SEQ ID NO: 2431 - DNA, 921 bp, Homo sapiens
ggcacgagctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagaagagatggttccacctcgtggtctgaagaacaaaccagagaagagtctggtttgccagaggccccctccggcccacgtcaccctgagtacacccctctgattgctctgctgtcaagaagcacgtttccaccagctgtattcaacactacaatgcattttttaaactatatttgcatccaagacaataaagacaccttattttttttgaaaagccaagaaaaaaaaaaaaaaaaaaa

SEQ ID NO: 2432 - DNA, 1723 bp, Homo sapiens
gcttaagcttccaaggctaaagttggaggtaatgcttgaagataatgtttgcttgcccagcaatggcaaattatatacaaaggtaatcaactgggtgcagcgtagcatctgggagaatggagacagtctggwwgwgctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagyagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcaaaaaaaaaaaaaaaaaaaaaaaaaaaaaaaaaa

SEQ ID NO: 2433 - DNA, 2310 bp, Homo sapiens
ggcacgagattgagtggggtccatctcggacataggctccaaatggaaaagaagctgatgcttggcgactcctctctggccctggtctggctgggcctctgcctgcctccctggggcaagcctgggactccactccttcctgcgctgccccggcccctttctcttgggggttggtagcatctgctgtcctgggtagaggtccttaaggacactgcttgcgtgctggttttcaacccccaagctgtctttgtgggtcacacagtatcactcaaataataggttacttgagaagttcggtactcccttttaattgttgtcgatacgtatttacttaagatatgtaaaatattttcttattttcttttaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataaaaatgttataaaacagtgtagtacagcaactgtttctatgatgttatctaaaatgatctaaatatttgagaggttttgcataggtcatgtgcaaataacctgttctctctttaatgaaaacccagttttataaactaaaactcttcctgtagaaagctaccagcatggatgcgcagcccttttcagctgggttggagcttcataggcccccagaggcagaggcgactgcaactttgtgcccttctgggcaaaggctagtgcgagcccctcagactacatctttactagaaactccaagtgttgcatgaaaacgagagcttgaccctcttttgagatgacagtcatatttcttgcaaatattttggcttgcacaacgaaaacttcttctaaatgtaaaatttccaatgagaacgaataaaccattttaactgatgtggtttaataattgctctaccatatatatttgttaagcagcattctctgctttgccttaatcttgaagtcagcatggctccggatcagagcggttccttgtgacttgctgggtcactggctggtgaaggaagcccccctttctgtttaccacgtctctagtgcccccctcacacagcagctccagagtttgcaccctgattgagttgagctgtgtcctttaacaatgggtcacttcaggtgagcatagaagtgatgtgtcccttatctccaaggcttccgtggagtgccctggggggtgtgggtcatgtttacagagcgtggaggccacggccaggcagcatctttagctggacaggaaaatgagaagtgacagcatttagagggaagcaaaaagaacaacacaggttacaggttgcaagtaattttccattttgtattttcgttctttttcttttttttgagactgagtcttgctcgcccaggctggagtgcagtggtgcgatctcggcttactgcaacctccacctcctggattcaagcaattctcctgcctcagcctcccaagtatctgggattacaggcgcctgccaccatgcccagctaatttttgtatttttaatagagatggggtttcaccatgttggccaggctggtctcgaactcctaacctcaagtggtctgcctgcctcggcctcccgaagtgctgggattatgggcttgagccaccaggcccggccccattttgtatattttttaaggctttcattttatgccagtccttcccccaggatggaacatggcataaaatcagagtcatcattagcattgaaatgtaattaaagcttggacagcttggaaaagaattctcaaagtatctactgtctttttcagatttttgtcatttcaacaagagtaaaagtttcataaataagattctttagtaatgtattagaatgaaagtgaaaaataatacagaaaaaaaaatatactggcctggcacagtggctaactccagcctggggacagagtcaagatccgtctcaaaaaaaaaaaaaaaaaaa

SEQ ID NO: 2434 - DNA, 1541 bp, Homo sapiens
gaattcggcacgagctgccttgagcttgccgccattctagcttaggctggatcacccacccccggcacagagaggagctgccttcaagacggattttcctgcatgatggaaagtggagtttgcacaataaaagagagagtccccattctcccatcaccaagagcagctcttcccatcttcacgtggtttattttggtcttttccagattggcattcatttaggattggctatgatgcatggggctggggagaattactgcttattgtaaaaaattcactcggtgctagtgacctgatgcccagcatcctcagtgggttttccctgtaaaaattccagtatgtgtcgctaaaatacaaatctttttaaaagcgtaaccacaataccatactgtttgatatgtaaaaatgaacggtaattgcttaatatctcaaagtgtccagtcagagttatatttccagttgtctcatgtacatcataatgttttgttgctcacttgaacaggattcaaataagttttgcacaatttcatttttaaattttttctttttcttttgccattaaatactctcctatccaaacacatgtattttaatctgtagcttcccccatttttattttttcccttgcagtttgttgaagaaacaagtcatttgcatctgtgtggcgttgttgaacatggtcctctctcctggccactacatcacattcagagttgattctcccctccctgttcagagactggtggtgggtgttctttatccggcatctctctgtgacagcagcagcatttgtggccataattggcctaaattcatgaactcattagagagtgcagaaaggtcacagcctgatacattcatgagatgcaattcattaaagagcaacttctccccagcaacttttgggttgactcgtggtatcatctgtaaaagaaaagtaggataaatgcttctttccccttttcatgccatttttgaaaaccacacattggttctccattctcttccaatgatgattaattcattaaaaaagttattacccttcctcacaccatacacaaaagctcactccagggccaggcgcggtggctcacatctgtaatcgcagcactttgggaggctgaggcgagtggatcacctgaggtcgggagttcgagaccagcccggccaacgtgacgaaaccctgtctctactaaaaatacaaaatttatggctgggcgtggtggctcacgcctgtaatcccagcactttggaaggccgargcaggcggatcacctgagatcaggagttcgagacccgcctgaccaacatggcgaaaccctgtctctactgaaaatacaggtgtgtttttagctaggtgtggtggtgcatgcctgtactcccagctactcaggaggcaggagaataacttgaacctgggaggcggaggttgcagtgagccgagatccacactattgcactccagcctgggcaacaagagcgaaacgccatctcaaaaaaaaaaaaaaaaaaactcgagggggggcccgtacccaatcgcc

SEQ ID NO: 2435 - DNA, 2074 bp, Homo sapiens
  misc_feature (2019)..(2019): n equals a,t,g, or c
  misc_feature (2043)..(2043): n equals a,t,g, or c
  misc_feature (2048)..(2048): n equals a,t,g, or c
  misc_feature (2061)..(2061): n equals a,t,g, or c
cttccgacatgcctccagcctccattttctcccttcccagttattccttagcccagccatctctgtctttagctcctacaattttcttaggatattctgggaaagatgagcggagactgcccgccttgtcaaatctagtgtctttttttcagtcctcacactgcttgacctatgtataacctcctatacttccctctttgcatactcctctgggttttctgtggtagtcaagattcctccctgagatttatttcccatgagtcttgacccctcccctcagttggtgctatttccccctacccgccctccgatgatcttatcagagcccacaggttcagttttctttcatgctacctgaatgtcctgataaactggctcrctctcttctttaccttccataatggcattaccatttaccacgccacccaagatacttactaggaacctcaaagtattgtattctttttctccatcacactcatacttaatcatcaagyccttttgagcttgtctcctcttgaatatgtcccttcttaattcctgctgccttcttagtaaaggcyttcattcttttttccctagtaataatcttttccatatgttccagttaaaataccatgttctccctattccttattacatagctagcattccttgaaaaaaaacaattctctcaggcctccatacctttagcatgttacccactctgcctctgctcttctggaactagaacactcatccttgaaggctgggcttctgtatgaaggttggtcctgcctccttacttgaggtgaagctttgtacatgcctgtattacggacatcctcttatttaagtgtttgtctctttcgtcattgggactccagcacccagcatagtccctagtatactagttggtgccgaataaatagtagctattattagaaaaggaagggtgaaattgacatgggagttagtaaaatgtatatggaaatgatttttaaagggaaaggtaatgattttctggcaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtagaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggyggatggatcacgcctgtaatcccagcactttgggaggccgaggtagggggattgcttgagcccaggagttcaagactagcctgggtaatataaggaaaacctgtctctgcaaaaaaaaaaaaaaaaagaggatacaaccaaatggaagaacattccatgctcatgggtaggaagaatcaatatcgtgaaaatggccatactgcccaaggtaatttacagattcagtgccatccccatcaagctaccatgcctttcttcacagantgggaaaaactactttaaagttcnatggnaccaaaagagccntatcgccagtcat

SEQ ID NO: 2436 - DNA, 2288 bp, Homo sapiens
  misc_feature (603)..(603): n equals a,t,g, or c
  misc_feature (2113)..(2113): n equals a,t,g, or c
  misc_feature (2158)..(2158): n equals a,t,g, or c
  misc_feature (2279)..(2280): n equals a,t,g, or c
tgtgcacagataaaattagaataaatgcagagatgctataacaagatgtcttagaaaaaagaaaaacaaagaataaatgcagagagaaagagaaatgtataaaaggtagagagataaacataccacaagttcatagaaaagaaaggttgtgtgtttatctgtggctgggatgatcaagaaatgcttcatggataaagagcctttgagccagacattgaaagaaaggtaatgttggacttgaggtcttggagtatcctcgttgaaggaaacatgagcaaaggcataggtagggatgggaaatgccggggtgcagagtgggcaggawtcgatttgtagttgctgggcaatgatgtgtgtaaaccactaaaggagaagwtcaggtagcaaaggtccttggaggccagaacccagagggccttgaatggcaygtgactaaatgatttaaacttaagttactggggagcawtggaagaatttgagtggctagagtccccatcctgaagaggccttgcggggatcagcatgtgggtgcctctggactgtgaaatagccagagctgggaagccttttagagctgctgttgtggtccaggagggaggtggngagggcctgggtgaggggaaggccactagatggagaaattgaatttatgagatgggatttaggaactgcctagataataggggttggccgatgggaagcaaaaatgcccccagagctttgaacccaggtgccattcattatttctatgccatctgccaggcattgcatagctattatctcatttaatctcctcctaatcttgtgggttggtattttcatccttatatcagagacgagaaaactaagggtcagagaaaattagcaattggtctaaaattgtacagttgtaacaggatctagaacagggacttcagtacaggcctccctgacccccaagcctgtgttctttctactgtactaggcttggaagacagcgtacgtgagagcaaagacaagctctgtccactctgtgcatattcagtgtaggtgctggtgagattcccgccttcaggtgtccagcaagtggttggagacatggagccgaatctcaaggacattgggaggattgaaggtcaaggcttaagaaccatctgcatcctcatttatttattcagcagctatttgttgtgtcttcgtggaccagcttggcagcatgaatgctgtgaccamcaagagaggtgtgtccttcacggagctgccaggctgggagggagccctgatggcgtggcttgagtgtaaggcaggaggtgtgcagattggctgtgggaacttactggcctaaccttgtcaggtcagggaagctctctagaggcagttgtggttctcaacatgagactcaaatgatgaggacccagataaaaagtgggaaaacagcataccccaggccgtggaagtagcgcgtactcaggcagagcaagataagaacacagtgtctttaaaccaaaaaccacgtgtggctggaatggagggaagagcaaggagataagacaggtgagcaggaaccagaacaagaaatgccctggaagctgtgagacgcttggaattcacctgtgaagaaaagagtagcctcatctgaattccttgcctcgattatggtctccaatagaagattaaatggctgtggagtctagaggttttttccttcggtgtgggcatcaccccttctgaaaggatggtgtartggctaattgtatgtatcagcttggcgaggccacagtacccagatacttggtcaagcaccagtctagatgtcgctgtgcaggtatttttttagatgaggtttaacatttatatcagtagaaggagtgaagcagattatcctttgtaatgtatgtaggcctcatatatcatcagttgaaggccttaagagaaaaagattgaagtccctaaagaagaaggaactctgtctccagtctcccttcagactcaagactgcaacatcggcctggcacggtgctcacgcctgtaatcccagcactttgggaggctgagatgggtggatcgcttgagatcaggagttcaagaccagcctggccaacatggcaaaaacctgtctctatttaaaaacacnaaaattagttgggcatggtggcaggcgcctgtagtcccagctacntgggaggctgcggcatgagaatcacttgaacccaggaggcagaggttgcagtgagctgagatcatgtaactgcactctagcctgggcgacagagtgagactctgtctcaaaaaaaaaaaannaaaaactc

SEQ ID NO: 2437 - DNA, 1156 bp, Homo sapiens
ggcacgagggagaaactcctcctcataccttctgcaaagttgacaaaaacttaaattgtggaatgtggggttccagcgtgtttctgtgttataagaagtctgtacctgcttcaaatgcaatagcatataaggctggtttaatttttagatatccagaagaggactatgagtcatttccactctcagaatcagatgtacctcttttctgccttcctatgggagctactattgagtgctgggatcctgaaaccaaatatccacttccagttttttcaacttttgtcttgacaggttcttcagccaaaaaggtatgtttttgtctcattgattaaacacattttgtccatgtttttatttcataaaaaggttaatacaagttttatttgaatgttaggattatttggacatgatacattttggtttaaatttacactgtcatccccaaggtgagaaatcaacatgaaaattgctatcaggatattgatacctctggaacttctacagaagcaaagataaagtctctctggatagacaccttcaaaacccaggtgtcaagatgagatgattatgacagatcaaggacataggtaccatagaaagaatcgacagacacaattaaaaagcagggttagaccctcaagacattgaaatgacagaatgacaatataaaggatgttataaattaaaatatcattgagatgacctaagaactaatggaggggctcaaaatatcaaggaaggaacaggatattttgaaaaatgaatagattgggaaaagaatcaagtgtttagaaatgaaaaatatggtccttaaaattaaaaattcagtgaatgggttaaacagcagagataaggccaggtgcggtggctcacgcctgcaattccagcactttgggaggctgagacaggtggatcacttcaggccaggagttcaaggccagcctgggcaacatagcacaactccgtctctactgaaaatacaaaaaattagccaggcttggtggtacacgcctgtaatcctggctactcgggagggtgaggcatgagaattgcttgaacccgggagacagaggttgcaatgagctgagactgcaccattgcactccagcctgggctacagagcgatactctttctaaaaaaaaaaaaaaaaaaaaa

SEQ ID NO: 2438 - DNA, 2488 bp, Homo sapiens
gaattcggcacgaggaagactcccatcgttttcgaaccaaggttcttccctaaagtgagttttaggtctccttttatttttccatatgtaaataatgcagaaggttactacattaagacacatagagaattgtctagctggcaaatgttaatagtggcttttactttaacattttttataaaggatctggaagcagttttcagttcaacactgaatttttctgtattatgaaatgccatgcttagaataacctatgtaagtgaaaaaaattggaaatagaatctggaattgggaggttattcaattgtcaatacggaaaaaaaggaggctcttcatatagcctttgaagacatgtggccatatattactgtattcagacaggactataggtaaacagaaggtatccccatagtgactggcgtcacagtttcgatataaatattgaattaaatgcatgagttatggaagggtttcatagactgtaatgatattaatgttgatacaccttgggtatatcaagctaaacaagtcttagagaataatgaaaatgatccagcagrtacaatagcatgtcataagagaattagctgtctttatttttatttgagaaggattagcataatatagaaagactatgtatatgagttccttaagacatggcaggacccttgccttttaatacatatttgaaaattataaccatgttgttcaaatcccaaaatactctgggaggagataggggccaaaaaaagaaaataaatcctttttcatggatggtagaattaggatgtttccagaaccagcactgtgcccatcgtagtaggcactgaatttttttttgtaaaagaacattaggatagctcctcaagagaggatgttgttttccataatgaacttcttctggtgctgctgtgagacctccaactccagtaggccactgatgtgtttgagctgttctgaatattctcttctccccagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttaaaaaaaaaaaaaaaaaaaaaactcga

SEQ ID NO: 2439 - DNA, 1640 bp, Homo sapiens
ggtcagagtgtgtgagctccctagtaggtgcagtagtaatagtaggcaccctttgctgttattgttatgaaaactgtcagctccaggatggtgctggaggtgacgatgatgttgatgacagggttgttaggaatggagttagtggcaagtggagctacagatgggcccacgggtatgagagctactaacaggaactttgactcaatttggcagaatcgtatttcaaatctaaattctctttccaccagctccttttgctataagggaaagccaagtggaaacgtagaggcatgtgcacccagatctcctgaaaagggcaataggagagggtagcagggaggagacaatcctctactgagctgaactggaaacgcctgattgtcatttcttccctgctttgccactgacgcccgcagcagctgatcaggaaggtatcagatgccttcactagctgtcactaacacctgcctcctgaatcctgatcggggagatggtgtcatcgggccctccacataaaatatttagtggcacttgcttcccaaagaggcaagcgtggcctctccttggcatcaggaacgctccgagttacatgtgctgggagactctcttgttcaggcgagagtcctggagcagcatacctggtttgagacttggagtaggagagagggaaactggtagaacagagactaggcaagttttggctcttgagaatgcatgtgacaagtgacttcatgcactaaacagagagggatgtgacagaaagaagaaagcatcattattaagagaaaactcctgaggttgacactagcagaaaattggggataggaggaagtcacactgggtatgcaaagtcaaatgcatgtttgtttaccagtgtctaccaaactgaggatgggaaattcattctaagacagatgatgggatggatggaggtgaggagctggaaataatgacaaataaattgctaataacaaaggctaatgtatcttaaacacttaagatggccatgaactgttctaagtgcttttatatgtattaactgatttcattgttataatcctatgacgtagctactagtactaaacctattttatatagatagttagataacatcatagaatggctaagtaccttgaccaagtgtacacagctataggctccatttgcgtccaggcacctaagttcagagctcatgcatttaattgttatatcgcactgcctctcaccagaggcacaaaggtgggctccatcctcccttactcagaatgtggataggagtcctgatctttgcccactgggctctgcttggaacagccacttagtcacatcaatttggcatagaaagatgaaggctctcaacgtgcccttgaagtcagctgtcttcatgaaggccacactcccaaggtggggtgcaaacctcccctcactgcaggagactgtgcctcctcttgactccagtgtccaatgacagctgctcccaggcgggcagtccctgagtcctgtgagatgaattcacttggctggttatcaggagtggcctgtcccaaagcaaatgctgcatgagggtgagaggaaaacagcccagctggagtggtctgtttagaactactggcctgaaaaaaaaaaaaaaaaaaaaaaaa

SEQ ID NO: 2440 - DNA, 1996 bp, Homo sapiens
  misc_feature (2)..(3): n equals a,t,g, or c
  misc_feature (7)..(7): n equals a,t,g, or c
  misc_feature (75)..(75): n equals a,t,g, or c
  misc_feature (78)..(78): n equals a,t,g, or c
  misc_feature (906)..(906): n equals a,t,g, or c
  misc_feature (1973)..(1973): n equals a,t,g, or c
  misc_feature (1988)..(1988): n equals a,t,g, or c
  misc_feature (1992)..(1992): n equals a,t,g, or c
annaganttctcacacattcttatggttcctctatgtttgctccaactgacacttcagatatggaagcagtattnttnggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcanctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtntattttttttttggntgtnttca

SEQ ID NO: 2441 - DNA, 2067 bp, Homo sapiens
cgcccccgcctcttagaacctagtgggttccccccgggcctccaggattcggccgaggctcagcctgctttgagcctcagtgagaagtccttccgacaggagctgactcatgtcaggatggcaggcctggtatcttgctcgggccctggctgttggggttctcatgggttgcactgaccatactgcttacgtcttagccattccgtcctgctccccagctcgctctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaacgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccatttgttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttaaaaaaaaaaaaaaaaaaaa

SEQ ID NO: 2442 - DNA, 2226 bp, Homo sapiens
ggttagctgtacgcctgcaggaccggtccggaattcccgggtcgacccacgcgtccgggggcggcccggccsggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaaaaaaaaaa

SEQ ID NO: 2443 - DNA, 1758 bp, Homo sapiens
  misc_feature (26)..(27): n equals a,t,g, or c
ggtcgacccacgcgtccgcttttttnnttttttttttttttttttttttttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattttagccatagcatctttaacattcttatttgcaagtcctagataatgatctatctgtgcctgatgccgttcataaataacaggaacactgaagagtgaaatgagagccaaaatcagtagtgtcagaccattaaacaaggcaccaacataggtaaatacccacatcaacactgcaaacttcagagaatcaactaaatcatcaactaagaagaggcgcctgagttcctttatcgtgcagttcacatgaccaagagcagaattactgtacttctgaaccaactcctcagatatagcaacttcagattccagatatgccctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactgcagaggagcgtatcacaggctcagatgcagcaggaagagcaaaaagggtctcatccactgagcccgaggagcccctgcgcttgggcgcggccggggtggaggggggcgcggcgggagccggggctggcggggtccacacgggctctgcctgggggctcacgctggccggggctcgtgcc

SEQ ID NO: 2444 - DNA, 1575 bp, Homo sapiens
ggcacgagaaagtgttgaatatctcatatagtttattgaatacctgcatccaaaagatgctggcaacacagcacactttagagcattggttgtttactctcttgatggtatggctgcccagcatcaagagttatcatactgcaaatcgatagcccaggaaaagagcaaaattcaaagttcaaagtagagtttttactgaatgcttgcttttgcaccgtcgtaaagttgaaaagaatttaaattgaaccatcataagctgcagactgtgcattttatattgaaaagttaatatttttaatttttaatgcagagaagtacccaaagcataagaacacaacacattttcacaaagcaaacacagccatggaaccagcacccatatcaactaacaaaatactagtttgggcttttttgtactttatacaaatggactcatataatgttcatcttttgggtctgcctgctttcattcaatattaggtttgtgggttcatctctgctgtgtgtagttctttcctgttctttatacagtgttccaaagtatagtatattacagtttacccattctactcttgatagtaaatgttttcacatttgggctattacaaatagtgctgcagtgaacattcacatacacatcttttggtgaacatgtgttacatttccaagtacaattgctgggtgatgagtatgcatactcttaaaacatggttgtaccaatttacacctctacgacagtggttccatacccttgccaacttcattttgttcattgtaggcattctcttgggcgtatagtgttattgcattttggttttaatttgcatttccctaatgactaatgcagttgaacacctttccaaatgataattggccatttggacatcatctttcgtgaagatcaagtcttgctcatttttccaatgggtcgtttgctatttttcttactgattcccaggaatcctttctatattctgaataccagtcctttgtattacaaatatgttgtactctgtgacttgttttatttttcaattttccagtttatgttgttgattgttttacttcatcccagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaaaggggcaggagtcagcaataaagctatgtctgatattttccttcactaaaaaaaaaaaaaaaaaaa

SEQ ID NO: 2445 - DNA, 549 bp, Homo sapiens
ctacatagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttaaatgttctctacagaagatttaaatcaacaaaaagatataaaattgcaaaggttgctcagtcaaaaccatgattatcaaggaagcaaagcttctggttccaaatttggtaatctgctacccatgttaagtttccagtttttatctggttgcccttcagtttagggaccactggcccagaacacacattactggcttagataccggcctgacataggaaagagagtggtagggtgaagagagtcattctctgcaggctcagagatgtgtaggcacaagggactcccgctatgtagggaatcgatatcaagccttatcgataccgtcgacctcga

SEQ ID NO: 2446 - DNA, 1397 bp, Homo sapiens
aaccaatcgagtacacggcggtcttgccaccagatagacggcgaaaccagcaaataatggcggaatcgttcggggcaggtgaacagggaatagaggccgtacaaggcgccgaacgaatggccgaagacggcttggttttgggtatcgatgcggtatttgctgttgagcagggcggagagttcgtcatcgagaaagcggctgaagcggtcggcttggccktattgtttgcgttcggattcgggcgcgttgtctggcagtggcggcgtgtagtcgagggcgcgttggcttaagtcgcggatggtgctgccggtgtagccgatgccgacaatcaggcaggcggcatggcttttggtgatggggttgatgagcagggattgcgccatattgaggatggcggggaaaaaggcatcaccgtcaaggatatacagcacgggatagccgcctgtcggacgctcgccgagtgccgcggcttgaatgcggtargtgcggccggtgtkggcggaagtaagggcggtttcttcggcttgcagcagagtggcggcttgccagttggggcggatgggcatgatggggtgctttaatcaatgggttgtttaagtaaaagggaaaaaggccgtctgaaaataggtttcagacggccttattgtaccgattcttgtctttttaacaatacgcgcgattagcgtacgtcaacgtaggagctgctgtgcagttcgcgcaggargttggtggtcgcctgttgcgctttttgttgggacaggtattggcggacggcgttttgttgacgctcttcaggcgtacctgcttcgcggacgtcgttcagcttgatgatgtgccagccgaattgggtgcggacaggggtgctgatttggccgggtttgagtttgtggacggcttcttcaaatggggcaaccatcatgccgtcggcaaaccagcccaaatcgccgccattgccggcgctgctgtcttgcgaagtattggcgtgccaaaccgccgaaatctgcgccgctgcgggcttgtgartagattttgcggatggtgctttctgcsccgacggcggcattgtcgttgtcggctttaatgaaggatgtgttgggcatggtattggcgcacagggtctgcttcaggcagggtgacgccttgttgtttggcctgctcgatgtagcgtgccacttcggagtsctcacgcggctgttttgcatgatggcttgttggcgcactttttcaacaataatgctgtcggcgatgtcttgacggacggcggcagacgggtttttgatgttggggttgtgcgcgataayggcttcgatttcgctatcggtcgcttggatgttgcggcgtttgcctgcttggaggatcagggattggttgaattcgatatcaagcttatcgatacc

SEQ ID NO: 2447 - DNA, 1285 bp, Homo sapiens
  misc_feature (315)..(315): n equals a,t,g, or c
cttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaanctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgaygctatygtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgkactgaaccacccttgkattcttgagataaattccatgtggtcatgatatataatcctttttaatatgctgctgaatttggcttactagtactttgktaaataaaagattttagtatctagtttgtcttttcttgtggtatatttgtctggctttggaatccatgtaatactggcctcatagaatgtattgcaaagttttttctcctctgttttttggaagagtttgagagggattgg

SEQ ID NO: 2448 - DNA, 985 bp, Homo sapiens
  misc_feature (372)..(372): n equals a,t,g, or c
  misc_feature (386)..(386): n equals a,t,g, or c
  misc_feature (391)..(391): n equals a,t,g, or c
aaccaatcctaatccctcctaaccccactcatagtccagagaagataaaaagttcagggacatggtgtactgctctccagatcctttcccagctgaaactctatacccatttagcactaatttcccattttccctagcccaagataaccaaccaccattctactttctctttgaatttgactcctaggtacctcacatatatattcctatttagtggaattgtagactatttatccttttgtgactggcttatttcacttagcactgttttctaggttcatccatgttgtagcttctgtcataatttccttcccttttaaggctgaataattttccatgtgtatatgtaccatatttgttcatccattcatncatgatagatactngagtngctctaccttttggcaattgtgagtgatgctggttatgaacatgggtgtacaaatgtctgttttgagtcctkgtttkgctttcgtgcattctattaaaaatgttaaggttcttkgctttttacttttttttctcttttatccaccttttgactttattcttaaagtttwatcttggtataataatttatggtatgttgcagaattaggagcaaagtcccgtgtgtccttcactcagtttcccccaatggtaacatttttcataattacagcacaatgtcaagaccgggaaattgacattgatacagtccatatacaggtgtcccttggtatctgtgggggattggttccagaaccctcgatgataccaaaatccatggatgcttgagtttattagataaaatggcatagtgttttcacataacctacacacatcttcctgtatactttaaatcatctttcgattacttataacacctaatataatataaatgccgtgtaaatagttatattgtattgattttatttgtattttttttattgttgttatttttcattgtgttttttccctgaatattttctatctgtgattggtt

SEQ ID NO: 2449 - DNA, 961 bp, Homo sapiens
  misc_feature (539)..(539): n equals a,t,g, or c
gcattgtgttaccatagattagttttgactgtttttaaattttgtgtaaatgaaatttggcaatccatacttttctatgccttgtttctttcaatcaacaaaatactactgcatattatgtttttgtatgtatcagtagtcttcctcattttattattgaatagtagtcaattgtgtaaatacaccgcaatttatctatacacctacttttgaatgttgcttttttcccaagttttttcatattatgtataactaccatgaatattcattacaagtctttgtgtggacttaattttttaggagtaaaatcggtgaataatatagtaggtgaatgtttaatttttcagggaattgcaaaattatttttatagttgttataccattttatatctccaagagcaatgtttcatacttccgtttgctctctatttttgaaaaccattgatgttgktagtatttatawttawttttgccatyctatgagtatctttctcaatatggctttaatttggatttkgagagtctatagtctttgctgntttatgtgcttattggtcctttttatatttttctttgtgaaatatatttgtgaaatatttactgttaattaacctatatctaagcttttaacttaatatctttatacatatgtttgtatttataggcataatgcagtgctagattttcttaattataaatcatgtamgagtacaaattgtaagcatttgtagccaaaatattaggagtattttgtggtctactgtaataaaatactgttctgaaagtcactactgttattttccaacttaaaaaaatggcaattgtgctatttctgagaccaaaaaatttttgagttcagatggctctatgctgaccaacagatggatcaggaaatagcagatggttttatgagcagttctgtcatctcagcatctgaaatgctttacatgccaatgctata

SEQ ID NO: 2450 - DNA, 1017 bp, Homo sapiens
tgacacattaatcaaagaaaatgtccatcccacatctttggtgtcatttttttaccttcttacttccttgcattaagaggcaaaagatccatatcaaattatgccatgtcttttgataaatacatttatgtgaaaacatataactcataactcttgatttttttcaccaaagaaagtagctgataataaaaaatgttccatttttcgtagcacaagctctatcaatttgagcttgttgatgcatttaagtgtgatgacattaattacactggcaaacactccaaaagcgcactttcttttatagcaaaatgccttttaaataaaatgttttcaaatctggcgaagaaagtttagaagggagataagcctcattattacttgtgattattataaatattaaacccttttatgtcataaattatagaaccttaaaaaagaattatcagcttcaagctaaatgctaaaataatttttcttcatagcaatatatctcaaagcaatgtgtgcataattataacttctgatatgttattagagctaaattttgatatgagaaatttttaaaactttatattttaatacaatttaagatttttccaatttttttaaatattgcatatttgatcaaagtggttgtgatttaagatgtaaaaattccccatttttggtaaacaaagtcttgtcaaaggatgagtagaaactacgtagctatgaaaaggttaattcatatattaggaacagttttactgcagaaaatttaaatcggcttaaaatgtttataccctcccactttctactgcaccaactctataatgaggtaggtcaattgagctttttacctgctttcaaaaatagcacaaaaatagttcttaagaattacgttgagtgagaatcagagattgaaaattatctgcaagaatatgtataacttccttctcccggcaccatcaaacgtgtttctctcctttattccccagattggttgaattcgatatcaagcttatcgataccgtcgac

SEQ ID NO: 2451 - DNA, 822 bp, Homo sapiens
  misc_feature (47)..(47): n equals a,t,g, or c
  misc_feature (799)..(799): n equals a,t,g, or c
  misc_feature (809)..(809): n equals a,t,g, or c
  misc_feature (815)..(815): n equals a,t,g, or c
  misc_feature (819)..(819): n equals a,t,g, or c
acccatggatttccgcccaaggctcggaaattaccccttcacttaangggaaccaaaagctggagcttcacgcggtggcggccgctctagaactagtggatcccccgggctgcaggaattctcggtcataggatatgcatattcggtttagtaaatactgccagtttttgaaagtgattgtactagttttacattcccagcaatagttgtataagatttcccttgttttgcatttttaccaatacttaaaatggcctgccttgagttgttgatacttgtgtcatttttgacatctgtcatccagactcaacctcctagggagcttgacccttcccttttttcagttttctctctagcctaggttcagtcagcaagacctatcagatttttcttttatattgcctttgtccttcctccattgccacagctcaaatattagtcatatatggagtaaatatcaggtgatttggatatcaggattatgacagtagtctgccagttggtgcatcttctagtatttctgcttttccaataaatcctgcacagccaagaaaatgcttcatgaaacaccgcaccattgctctgctcaaaagccgtcaacaacccttcattgcccattggatatcagccttcctccccctcttccttttccacctgtacctctcttccttcctcccttcttccgttctttttttttaattaaagtgtaatatatatgaagtgcactatgaccgagaattcgatatcaagcttatcgataccgtcgacctcgagggggggcccggtacccaattcgccntgggttccanagaagntcantag

SEQ ID NO: 2452 - DNA, 822 bp, Homo sapiens; identical to SEQ ID NO: 2451
  misc_feature (47)..(47): n equals a,t,g, or c
  misc_feature (799)..(799): n equals a,t,g, or c
  misc_feature (809)..(809): n equals a,t,g, or c
  misc_feature (815)..(815): n equals a,t,g, or c
  misc_feature (819)..(819): n equals a,t,g, or c

SEQ ID NO: 2453 - DNA, 1087 bp, Homo sapiens
tatagcattgaaaatcaaataatctaaaagaaaaaaaacaaacaaaaaaataattaactgaggagaaaagacaactactatcagagaacaggtcataacaagatacttcttttccccaaagccattgctagctagtatatatatattcccttcccctgtagtttgttccaaatttcaagtgtgatgatagtttatttgcacaaacgagacagacaaaagttattctaactagaatgcatgctctctgagagcaagactaatacctctgattcttttagagagcctaggtcatgtattttgggtgtgggaggccagattgtgccacccccaaatatgaagtattactgagctaaagacaattaagggaagcaaatgcaggaaagctctctactcttcctctctttgtcttaaagcaggacatagatttataaggacaaaaggcatcccacccctctttctccaagtagaacaaaggttaaccactaaagacaacttttgaccctgattgtctagagatggtactggaagaattttcatgcataagtttcactaaccagcctttatctgccattgttttgccttctcacaacttgctgctcctgggagactcaaagttcttttcctttgtcttgtcacttctctaaaatgtacggttctttgttgaagatgttgttgggacaactaagcttctcctcaaagactcaacctcctggtcataagttgcaaaagttgtaaatcaaccctacccactttcttccccaccttcttcttttcacaaatcacatgtttaccttatttggaaaagtttaagtctcagccaatcaggatcagcttagattgtgtggtccaaccccagccaataggcaaaggacacagaaacaggaactgcactagggttaaaagctccttcctcctttgttcagtgtgctcttgtgattgcatcaggtgcaagtagtacccttctgcagaagtaaagttgccttgctgagaaattttctgtctgaatgcgggtttcttttggctacactgagcacttgtttccaacaatgctatagaattcgatatcaagcttatcgataccgtcgac

SEQ ID NO: 2454 - DNA, 1220 bp, Homo sapiens
  misc_feature (958)..(958): n equals a,t,g, or c
aaccaatcaactatcaagcagtagtaatctatctttaaatttctactcggtcatgcaagtaaaaatgccatcacgccttcaatcccaaaattcccaaattcccaaatgtaaaaaagtccatgcaacaaaatgagaaataagaaccgttacaactgagattactggagtctcttccggaagacaaattatcactgtaatatgtaatatgaacatgtgaaggtctggctcatgttttatgatacacaggcttcaaaagttgtatgagctcagatagagactgttgtttgcaatttgttctttcactaattagctatgtgatttagttaaaaagttcaaaagattgtagtaacgattaaacaaatgtgtggaagtttgacctagcagtgtctgacccactcatgatatatatccaaccaatactagttagttctgattaccttaaaactggctgctcaacttacaaatcttaggtcaaatcacaggccctctaacgactacatataagaaaaacctatcaccaacgatcataaggtgccatatcaccaaggatcttctatgccatgcagacccaatcaatacaaggcagaattgatttaatacagtgtttctctaagtatgaataggcaggtatcctaatcattaagaaaaggtgctttggaagcagaaaggctgcgttcaaattctggctctatcacttaccatctacctaaatttaggcagttcttttattctctgagcctacttaacttatctgtattattcctataccccactgagttattgtgaggattaaataagtacagagaaagtgtgtggaaaagtgcttcaataagaatgttagctattgccactgctattattatgctccctaaagaatattccatgacccaataaacaggaaacactgctagagagtcacatgtgttattgcatttgacatcctgaggaaaaaaaaaanccctatttaatcaaataattcttaaatttatttaactctggcatccttttctcaaataacattaactactgtggtagtaatgtgccgaagaatactcttaagtgcaatgaacactataaattttctataaagctgtatatctaaacataccactgtaccacatagcctatttctagtccattccagatgcaatcaaaatttccctggcctcaaaaattagaagactaaaactttcattacctcttgttcagaaggattggtt

SEQ ID NO: 2455 - DNA, 951 bp, Homo sapiens
ttctatagcattgcatttcttaagtaactacatacacacataaatatatcactatcaaaaaacatttctgtcacctgagggagtttcgaattttctatgtctcttcctagtctctttccccaaacctctactaaccatagttaattttgtctgaggattttatataagtgaaattatacagtaagtgtaaagtttttgagatctattcttgatgtactttatctgtaatttgttgcttttacttggacatatatatgtgtatatatggatgtctgtctatatatatatgtataagtaaaaactttagaaattttagaaagaaagcttttagaaatagagctactatgatcactctcgaaccaggtagtctttctttgttcatatgctttcttttctcttaagaaagtattaaggagtggaattgctgagtcatagcaaaaaaaatgtatgtttaacattttaagtagcttctaaatcatttttcaaagtgattgtgtcatttcacactcccctcatcagtatatgagagttttcacttaatttccagcatttaagattgtcagtctttcattttaatcatcttcttttgatgcttctttttgtctctgttctctaattaatgaaaaacattgggatcacatcaagagatataaaaaaaattatgcctttccaaggattaacctttgtgaaatttcagtgtgtcttgttttctcactataaatcaacaggtctgctgcacgagagtcagaacatcactacaaaatgaaaaacctgcaccaggagagaagcgagaaggcactgctaagggacactcgatttactcaagatggaataagtacaaagttacgtagtcaggagaactagtacgaaaaaggaatcaggtctgtgtcagagtaaaaattgcatctagcaaatttaaacaggcaaaaaagagttattcaaggccaatgc

SEQ ID NO: 2456 - DNA, 1071 bp, Homo sapiens
aaactccgtctccaaaaaacaaaaaaaacaatataacacgaacatgctaaaatgttcacatttagggaacctgggtaaaggaatacaggagttctttaaattactttcctggcccttccacaagtctgaaattggaaattatttcaaaataaaattaaaaaaaaaaaggatccttgcaccagcttcgataattaaatgatcatcaagctctctaaacaagctaatgacactgggaaatgaaggactttgtggtgactgggaaaaggaaccccgattgtgtgttctcactacagggatgtcctcaacgttcttattctctttggctcttgctgtgggtcattggagacaatgtcctgaagaaagttctatttttctgccttttaaaaaacagaatacttaaagtaatttcacaaaaaaaatggccatctgtgaaaggtctatttccaatgtgctctgcctaaccactctggaatacatttcttgtgttaacattatagattaatttctccctctctaataaccatttaagtacagtgaatgattctggcttgcctatgaactaactattctgctccttggtgccaacggctagaactaaaaaaagaaaaatcaattaaccttatgctcctggtatttgtataaactgctactgattacaagcaggatgagtggaaatttgaaggctgttcttggccatttcattcacattaattctaaatcagaataaaaagctacaaaattcaaagtgacggtggatcagaatcctggagcttttatttttctggcaaagccgaaagtgctttccttccctcggtgagccttctggttgctgggccaagctgctggctgtaccctcctccccacagtgcctccacgctcacctgacgctgggaggtagggtggacatccactgctccttcagtcactgaagattaccctttccagaggcgacatctgttttaaacttaaaatttctccttacctagactcttctgaacattccggtttttttttttttttttttttgagacggagtttgaattcgatatcaagcttatcgataccgtcgac

SEQ ID NO: 2457 - DNA, 563 bp, Homo sapiens
ctacatagcgatagtatggtttgataatacagtttttctcctctagctgcctcctgttcttgaggtaatgctcagtgattaactagataggactagataatttatttcaccttggcaggtcttgcctccaagttggcctattcctatggtatttccttttctttcttttgcttcttcctgcacactaagtatggtattttctgacagtatttttcttaattctttatttatttttcttggtaatttcttgctgtagagctggtacccattagacataatgactttccttgacttgcttcttgctcataaatttctgtaagacaatcaggaagtttttagaaacaaacagtggaaccaattaggctgttaagtgagacacgcctaaattaagctatgaggaaataaatacagctccagcaaaaatagaaataattttcagattatccatgcttttgtttccctggttttcttcgaacctcatttcctcaagctatgaagtgaaatgaagtggtaagtacaccgctatgtaggaattcgatatcaagcttatcgataccgtcgac

SEQ ID NO: 2458 - DNA, 2930 bp, Homo sapiens
  misc_feature (1911)..(1911): n equals a,t,g, or c
  misc_feature (2687)..(2687): n equals a,t,g, or c
  misc_feature (2700)..(2700): n equals a,t,g, or c
  misc_feature (2775)..(2775): n equals a,t,g, or c
  misc_feature (2888)..(2888): n equals a,t,g, or c
  misc_feature (2897)..(2897): n equals a,t,g, or c
  misc_feature (2907)..(2907): n equals a,t,g, or c
  misc_feature (2917)..(2918): n equals a,t,g, or c
cggcacgaggtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatatatatatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaatgtcatgctgtttgaaataattgatactggtcttacgtaatacattttactgtatgttttgaagatggtnataatttcactttcaaaatttaaaaaatcaatttttaaatgttttaaaaacatatagcttagggatttttttaaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcncaatgtgacttancagtacccacccctcacccccgcccttatctgtggtggatacatttgcaagatccccagtggatgcctgaaaccncagatagtactgaaccttatatatactgtttgttttcctatgcatacatatccctatgataaagtttatgaatttggcacttaacagcagaactaataagatgaaaaagttgnaacaatatnctctaataanagttatttannatgtaaaaaaaa

SEQ ID NO: 2459 - DNA, 932 bp, Homo sapiens
cgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccatttcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaaaaaaaaaaaaaaaaaaa

SEQ ID NO: 2460 - DNA, 2904 bp, Homo sapiens
  misc_feature (2899)..(2899): n equals a,t,g, or c
ggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcagcatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctggggctgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttwattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaaaaaaaaaaaaaaaaaaaaaaaaaaaaaaaaaaaaagggggggnccccc

SEQ ID NO: 2461 - DNA, 1959 bp, Homo sapiens
cggcacgaggtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttagaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaacctgtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggttttttttctttttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgctagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactcggttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaaaaaa

SEQ ID NO: 2462 - DNA, 1139 bp, Homo sapiens
ggcacgagcaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttctttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaaaaaaaacaaaaaaaaaaaaaaaaaaaa

SEQ ID NO: 2463 - DNA, 2455 bp, Homo sapiens
  misc_feature (2454)..(2455): n equals a,t,g, or c
ggcacgagcttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaagaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagkttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacaaaaaaaaaaann

SEQ ID NO: 2464 - DNA, 772 bp, Homo sapiens
ggcacagcggagggtgcagtgagctgagatcgcaccactgcactccagcctggcggcagggcaagactctgtctcaaaaaaaaaaaagaaaaagaaaagtgtgctctttcatttccaagtatttaaaatactcctgttatcatgttgttatttttagtttcacatttggcctgagcacaagctcgtttaatttcaaaacatttatatttgttgaagtttgttttggggccataaacaaaaagcccataaacaacatgcttgtggagtattccgtaggtacttgtaaaaaggatgtatatyctggtgttgtttggtaaaatattctgtgtttatggatcctgttgattaatgatgttattcagactttctatattttcctcattttttgtctaatattttgctaaaagaaggatgttaaagtccccaacagtaattgtggaattttttatttcttctttcagttctatcactttttgcttcatatatttgaatgttctcttgtttggtgtatatgcatttatgattattatatcttcttcatgtattgtccctcttatcattatgaaactttcctctttgtccatgttcattttctgagctctgaagtatactttgtcttacactaatacaaggtataattgctgcatttttaaaagttaatgtttgcatggcttatctttgtccatttcttttattttcaacctgcctacatcattatatttgaagtaaattttatgtagacaacaaaaaaaaaaaaaaaaaaaaactcgag

SEQ ID NO: 2465 - DNA, 1481 bp, Homo sapiens
ggcacgaggtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtgggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaa

SEQ ID NO: 2466 - DNA, 1377 bp, Homo sapiens
ggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccccaaaaaaaaaaaaaaaaaa

SEQ ID NO: 2467 - DNA, 1173 bp, Homo sapiens
gaactagtggatcccccgggctgcaggaattcggcacgagccgatctgctccggccgtagtaatccgtgaagaggccgtcagggttgagcaggtagatggcaatggagtggtccacgatgtagtcctggtcctcatccttggggcctgcattgtagtacacgcggtaactgtgactagcctgggcaacctgtttggtggagccggtcagacccaacagtcttgggtggaagtcctggacgtagcgggccatggcttcaacgtcgtcccgctcggggtccacagtgatgaagacaggctgcactggaggcaaaccaggctctgcttccagctgccgcaccacctgcaccagcttctccagctcgtctgggcagatgtcagggcagtgagtgaagccaaagtacatcagcacccactggccccggaagtcagccttgcagcgagcccggcctctgtgatccagcaggtggaagtcgccctggcccacagctgcctggcgcagggcttctgttcgcttttgctgctgcagcctctccttctcagccctcagggccagccaggccccaccgagtccagccccgaacaggcctgtgatcagcagccgggttcgaagcccagggccctggggctggccctgcccacctgtctctgcagggccctgccttgacaaaagccaggacctcagatgcagggcctggcctcccagggtcccagggaggacccgaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaaaaaaaaaaaaaaaaaaaaaaaaaaaaaa

SEQ ID NO: 2468 - DNA, 1098 bp, Homo sapiens
gcgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgaaccttaaccccagtgagcgtgaaaaagaaagttaataaactataatacatggaagcaaaaaaaaaaaaaaaaaaaa

SEQ ID NO: 2469 - DNA, 692 bp, Homo sapiens
tgcaggaattcggcacgagtgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcctctgcttttctgcaaaaaaaaaaaaaaaaaac

SEQ ID NO: 2470 - DNA, 658 bp, Homo sapiens
tcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaaaaaaaaaaaaaaaaaaaaaaaaaaaaaaaaaaaaaaaaa

SEQ ID NO: 2471 - DNA, 1134 bp, Homo sapiens
ggcacgagtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctggggcactggggaaatttaaaaactccccagataattctgtgcagccaaggttgagacctcctagttctagagctttgctatacacagggtggtccacaagccaggagcatcagcatcacttggcagcgccttagagattcagaccccagacccactgaattctgaccctgcattttcactagaccccaggtgatcagctgcactagactcaacctcttaaaccaagaccctcccaccctcacagtctatgatcctttagtgaccctcagctgagtcctgtgctgaactgtgtttggttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcaaaaaaaaaaaaaaaaaaaa

SEQ ID NO: 2472 - DNA, 1175 bp, Homo sapiens
ggcacgaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccatcctgcccctttctctctccagagcttgggaggagtcagaacattgctctagccgctggtgatctctcctggttgccaaccctcctggccatgactgatctccccactgagatgctcaggtgattaaacgagagcccagttgtggcccgtgacactgtcactggcaagggtaggggtggggacaggggcaggaaaataagttctgagcagcccggaaataatgagtggtgactgcttctcggggctttgcctgccacagcaccactgtgctctcctggtcatggtgcacggagggccagcaggtgtggggccctgccacaccggaacagcaggccacagcagccatgctgtccctcatacgcacacgccctctatgggctgcagagtgttaccatagcatctcgtaagcctcacttcccaccggtagtaggatattgtcactcatttaacaggtttgaaagccaagctgcccagggaagggacttctcaaaggtcgcgagtccagtgagtggcagaagggggatgtaaagcccagcccctctgatggagtgtccagcgctcgtcccgtgccctccacgcccctgtgtacccagctacttgtttattcatttggtttatacgtttggtcgttcattcatttggtcagtgcacattcttttatggccacacacctgctagggcagtgaataaacggatatggaggcaaatccactggaaaaaaaaaaaaaaaaaaaaaaaaaaaaaaaaaaaaaaaaaaaaaaaaaaaaaaaaaaaaaaaaaaaaaaaaaa

SEQ ID NO: 2473 - DNA, 553 bp, Homo sapiens
ggcacgagcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagagaaaaaaaaaaaaaaaaaaaaaaaaaaaaaaaaaaaaaaaaaaaaaaaaaaaaaaaaaaaaaaaaa

SEQ ID NO: 2474 - DNA, 1463 bp, Homo sapiens
gggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcattcgatgacctgatgcagcacacgcacatccagccctggtacctgcggktggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatggaaaaaaaaaaaaaaaaaaaaaaaaaaaaaaaaaaa

SEQ ID NO: 2475 - DNA, 475 bp, Homo sapiens
ggcacgagctgacgcagcctatcgtggtcaccgtgccgcggccgccccccaggccgcccaagagtgtccccggccgtgcagtgcgccctgagcctcccgcgccggcccccgcggccctggaacccgcgccggtggtggcgctggtgttggcagccttcgtgctgggcgccgcgctggccgccgggctgggtctcgtctgtgcgcactcagcgccccacgcccctggcccgcccgcgagagcctcgcccagcggtccccagcccaggaggtcccagtgaggaagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgacaaaaaaaaaaaaaaaaaa

SEQ ID NO: 2476 - DNA, 636 bp, Homo sapiens
  misc_feature (622)..(622): n equals a,t,g, or c
ggacgctggcactgagggcctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtcygctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaawwaaaaaaaaaaaaaaaaaaattactgcggnccgcaagggaattc

SEQ ID NO: 2477 - DNA, 520 bp, Homo sapiens
ggcacgagcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgcaaaaaaaaaaaaaaaaaaaaaaaaaaaaaaaaaa

SEQ ID NO: 2478 - DNA, 1506 bp, Homo sapiens
  misc_feature (1359)..(1359): n equals a,t,g, or c
  misc_feature (1410)..(1410): n equals a,t,g, or c
  misc_feature (1446)..(1446): n equals a,t,g, or c
gtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtgatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaatwcataactaatgcatagaaaagatacataaagcaatgtgaaagtttcttgcttctcctttttaatttctaaaaaagccactttgaatggaanttgtcatccgtaaaagctgaagtgtaagcactaggaaatctcaatataganatttgaagaaagttatatccactaaggtggcagtcnttgatcataataagtgaaatgagccctgttctagtacatgaatttaagcttaggtattag

SEQ ID NO: 2479 - DNA, 906 bp, Homo sapiens
ggcacgaggggattacaggcgtgagcactgcacccagcccaaatgagatgtttctaaatctaaagtttcttctgcttctgcatttctgtgaatctcatttgaaatttttcagggaagggattttatcatttgttcagagatgtctttatttttattaatacccataaaacgtttgtgtatttgcttcttcctctttctccttttgatcacattttagctacttatctagaggatctctggccaagtattcccttttattgtattgataacaattcttaatggctggcctctcttgtgtacaatgagccaatattcttttttgttctatatttttgtatcttcccctttcctgaacaaagcatatttagagtctcaaagaaatcctctccacaaagacatgttcctccctctggtgtgggtagacatagggtaagagtttggatgaaacttttgtaaattgtagtgttcttggcataaatatgaattaaatctttttttatatttaaataactagttaaatatgtgcttcttactaagattaggtattttttgccaagataacaatgataaaaacattttgggggggaaattgaccttaaaattttgggataattcaagaaatgtctgcagaaaattgatttatgatcttaatttttgtgttagtcctttgaggtttttttgtttttgtttttgttttttgtaaagcgccttatctgttttggacaagtccaaagtaaatggttgggctcttatatctgttttacccttatttttcccattaagtaatggtttaagaatatatcaagcaccttaatttgttgttaagtagctagtgcttacaggattccattaaattcactttaataagcctaaaaaaaaaaaaaaaaaaaaaaaaaaaaaaaaaaa

SEQ ID NO: 2480 - DNA, 774 bp, Homo sapiens
ggcacgagaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaacctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggtggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaaaaaaaaaaaaaaaaaa

SEQ ID NO: 2481 - DNA, 1236 bp, Homo sapiens
gcttgcagggaattcggcacgagtgtgagggagcaagagagaggggtgtgggagagaaaagttggaaaggagggagagagggagtgggagatgagtacaccatctgttttgctattttattcatctttccttcttatattcatcctttgggatgaaagactggggagtattgagaagaatattaaccatcaatttgtaacatacccttgatgcgttgaaagaataagccgctgctaccatagtgttatattggattgacaactatttattgacatttgctgtaccatttaggggataagcagagaagtatttgagaagaaagtattttgtaaaaactgataagaaatcttagtttgattccagtcattaacacttgagtccttaggcagagttaagataatgattataatactttagtcctcttcttgggatcaactgggcagggaaacattcttttaaaatgggagatgtgttgccaaggtactttgttacaaagttttgttgaaaaattttacaatgtaggaaaagtggtatatttttaattgtggaatttacaagacacagaactatggttatgtgtttctttgacttctgaagagtttctcaagttaataataattagacttgagaatgtaaacttcacattttacaagctaagctttagagatcaaagaatgatttaggtgaattacttgatatatccgtgttgacaacccatgaccatttatgcctatgtaagtataaatctgtgccacccaagtaaaatattataaattttatggtctattttagtcagagatttatgggtatgtttgtgtctgagttgttttctgagcataatacattgatatatcgtgagtttcctaacacatattaagttgactcacaatgtgttgttggtctgcagaactcatacatattttatatgagatgataccatcagtagacagtcttcgctctcttcatcctctatctataaattgttattaacaagaaaaattaagtttctccttttgtggccctaatatagttcaggcttaaaatcaacagcaaccatcctatatatttcttttaaatgaggaaactagagattgtacacattttatccacagagatcaaaaaaggttctgcttgctattaaccctaatggctttcagggaggaagcagcactctagcaagggaattagtattttaaaagtttctgttggggcaaaaaaaaaaaaaaaaamctcgag

SEQ ID NO: 2482 - DNA, 2071 bp, Homo sapiens
gctatagaaatgttttggtttcttttcctcctcctccttctccagaactggctttattaacagcaagaattcaagcagtctccctggtctctcatgcagttcaatccccgacagcctttcctgtaaatgccacctgctgtcacatgctccatccgggcctttgttgtcaggctcacttctttctacatcttcctccattgacttcagcagctccttcatgcatgccacagttttttctgaagtctttggatgcattttcttaatgacaacatcaaagttcctgcttctctctgtgttaccaaatactttgttggagttgttgatctgacttgggactttgtaacattcactgaggcagacatgtattttagccatagttcaaatcctcctctctgggagctggccttgcacctctggaaaagaaccacatgttttgatcacagtggcttccaccaagagctggggaccactgacaaatggctggcccttcccccccaattctaaaggcctctgccagagctccagaagccgggcggagcctgccaacaaccattatcagcctgtccgagtagaccctatcttcttatttgaagaaaaaccccactttctttagaaaagttagatatgtgaagatgctggtctacagggtccttttgaaaacatctaacatcttctatgggacgtttccacagttcaccacctgaaacacttggaccacacatgtttgcacatcctggactttctgtctgatacatctaggactgaacaatgggttctcccagaagttccagagggaattcctacaattctcgcttcaagatggcgctccagctgcatcacctgcaggcctgggctaggatatgtcttgactctccttatgacactgtcttggtggctcacttgggtgagtgtggggccaatccaagggaagttgcggggaagctcaaaaaggtaactcagattttcttgggagaagagagattctgagcagattggaacgtaccatcaacagtgccttcttcctcctgagctgatatctgaatgagtccctattcacaggaagaccctggcccaccttgatgtcccactcaactgtaatccattggtcctttttgggcaatgactgagtcctctcctgaccaaggaaaggaatgcatctcaagcctctccccatcaggccttcattagccccatcccctacacccactgactctgctcccactcccgccactgtatcgcccagcgttgcttcctgcaggaaaccctgctgaggagtctagtggaggcagagatgccctgtgttgaacactccaccatgcattatgtcattttctccacacaacagccctgagaggaaggaagtgttattcccattttatagaagagaaaactgatgctcaaacaggttaaataatttctcaactattgactgaagagcatgggatacaagttctaggccattgtcggcaaagtctgtatgcttcacagcttggctgtgggatgtgctcctctgccttcaggagccaacccatcaccttggccaaccctttgaccagtgcaaacactgcatctttgtcagcctcctctgctagcacagccacccggccacctctataaccaatgccaacagctcttgcaagagcaggaaagactctccttagaccagagtgtcccatcctcagcactattggcattttgaacctgataactctttgtggtgatgaggtgttgtcctgtgcagtataggatgtttaacagcatccctagcctctagttgttctctggttgagaacaactgccctagggtactcatcctgtcagctctctctgcttttgagccaaagttcctgagaaagaaaggtctctgatgcaaagcctgtccccactatagcactttgaaacactactcttgctgggacaggcacctaaccaggctccctctcaccatctgtcttagtccagtccagctgctataaccaaatccatgctggatagaagatacatgacagaaatttatttgcacacaattccggagcctggatgtacaagatcagggtgtcaggatgctcga

SEQ ID NO: 2483 - DNA, 1467 bp, Homo sapiens
gccagtttttgtctcagmatccagatactatctaaatatgtttgtcaacctttggtttccttcctatggttgatattaagcctttcttctactcttagaagacaaaatggggagacaaaaaaggcaaccctgaaggtttttatcctttcagggtatctagcatttttctaatttagccctactgaagtttcttcagtaattaatcatctgtttttcarcctctaacctggctaatattatagcctacaattgtacttttaaagcccttttgtgactttgacatattgtgtctattgtgtatggaaaagtagcaggatcagtatgaagataatacagtatctcttaaaacaggcagccagcaaatgaactttctgcattggtcagaatttccatcatttcactgttaatgaggaaagtacagttctttagctaccatgaaagtcaaacatatcctaagccttttggaaaaagacatacatgttagaaaatctcaaatggatgagtcagcctgactgaccccacattgactccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgkattcagctagtataaaaatgcaaatctgctcttatgcctaaacagttaggartagaggagacttggcttcctttggaaagtcaggatgatagcttyatcccattctggkttttgkgawtaawtgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatgaaaaaaaaaaaaaaaaaaaaaaaaaaaaaaaaaaaaaaaaaaaactcgag

SEQ ID NO: 2484 - DNA, 1201 bp, Homo sapiens
ggcacgagagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgtcctattcaggaacaaagaatagatcacaaattaaactctgtgggttttcataagtggaaagttggctttcgttgttctggtatttgggtgctttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaaaaaaaaaaaaaa

SEQ ID NO: 2485 - DNA, 617 bp, Homo sapiens
  misc_feature (1)..(1): n equals a,t,g, or c
  misc_feature (9)..(9): n equals a,t,g, or c
  misc_feature (29)..(29): n equals a,t,g, or c
  misc_feature (39)..(39): n equals a,t,g, or c
  misc_feature (41)..(41): n equals a,t,g, or c
  misc_feature (154)..(154): n equals a,t,g, or c
ncccccatncctggctaatttttgtaganagggggtccncnctttgttccccagactgggagatttttctgtacttggctgtatgctttccattgatctgctgctgttttcactattattccttcttttgtgtgggtattttcttttgattttnagaattttacttgtaaacatgctacatatacatataatttggtgccctgtttttccatttacatattatactttccatattagtacattgtctgatatttctgcataatactcaattcaacttacctgctattgtttttatcatatctctattacaaacattaggcccatttcccttttttaaaagaggaaagtttgaggttatgggcggtgttctgataaaataaataatattttgtcatgtttgttttttcattgattaggaaacattgttttgaatttaatgcctcaaatttggtgcacaataatttgaagggaaaaactgacaagtttgaaatgaacattgatattacataatttacattaaaatgatacatcttttgtaaatttgtaagaagaataaataaatgaaaacctgattacctttcaaaaaaaaaaaaaaaaaaaaaaaaaaaaaactcgag

SEQ ID NO: 2486 - DNA, 637 bp, Homo sapiens
aacctctgcctcccaggttcaagtgattctcgtgtctgagccacccgagcagctgggattgcaggcatgtgccaccacgcccggctaatttttttgtatttcctttttagtagagacatggttttgccatgttggccggggtgctcttgaactcctggcctcaagtgatccacccacttcgggctcccaaagtgctgggattacaggtgtgagccactatgcctggccaaaagtaaccattttgtttaattttttctttttcttttaattttaagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgytaaattaatttcttattctccttaatattccatacacattcagattccttctcccctacaaaaatatttgctattttgtccttgctatttctcatacttagatcattcatacactatatttattttttcattaaactattttaaaacctttggaaaaaaaaaaaaaaaaaaaaaaaaaaaaaaaaaaaaaaaaaaaaaaaactcga

SEQ ID NO: 2487 - DNA, 1610 bp, Homo sapiens
ggcacgagtcaaaacaagtatggattttgaatgtgaatattttaaaagatatattgaaattacttagagtagccctggatatatgttcattatggcatttatcttgttaataagtttctacatgctcattttaatttccagtagcatgagcaagtaacttatatttcattcccgagaaactaaaagaatctgcctaaagagtatgaaaattgccattaaatctgtattgtctactttctggatggttatatcattatagttctctgctcttccacacatttttgggctgctatcagtttgtaagtaatcattatacaaactaaatttaaaaatttaaacaagataattttatattacttggatcagggaaaaaatgcagttgctgaaggtggtttcatagctaaatataagcaattattttgctttttctacttttttggattttatcatcttttcccttttagtaatagagtaatacaggtaggaattaacttagcactgccaaattaatagtaatattagaactgtgtacacagcacagggttaaggttatatagaaaaatgtctcatccatgtttaatttggctgaccagcccagttgattagccaattttattgttttgttaaattaaaattctaaatatagttgtccattgttaaaataagtgagtagggttaaaatagagaattgataaaaataaagccttaaaaatcttttagctaaagtagcaggcttcaagtgaaattcagttttggtctcctttacaggaatagctattcagtcagacagaaccacttatcacgttttgcagtatctcctgaggaagtcagaattctgagccagcatgaagacggaatcttgtctttgatctgatttgcaaaccgtacttttattctaatcatgtgcaaggtggaggttatagcgtgggaactaaaatcttagtaagtgtggtttttattttagctattaagtagtatactttcttatagtgatttttttttcttcttagcagagttcacactataaatagtgtatggacttggcaggcaggaacataatacagtatacttcaaaagtgaaagatttaggccaggcgtggtggttcatgcctgtaatcctagcactttgggaggtcgaggtgggtggatcacgaggtcaggagttcatcaagagaagcccggccaagatgctgaagccctatctctactaaaggtacaaaaattagccgggcatggtggcatgcgcctgtagtctcggctacttgggaggctgaggcaggagaatcgcttgagcctggggggtggaggttgcagtgagcttagattgcaccactccactgcattccggcctgggcaaaacatagcgagactccatctcaaaaaaacaaaaatgaaaacaacaacaacaaaaaaacaaacaaacaaaagatttaaccctctaggttcaggaaaaatccctgagaaagagagagcaaagcttctatactctgcctaggatttctttctctttccgggtgaaaaataggcgttgggatgatactgagttgataaaagtattaggaaaagtggccagtgtctaaattcaagccattaaaaaaaaaaaaaaaaaa

SEQ ID NO: 2488 - DNA, 2008 bp, Homo sapiens
gcccacgcgtccgcccacgcgtccgcccacgcgtccggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaaaaaaaaaaaaaaaaagttttgccctataggtcgac

SEQ ID NO: 2489 - DNA, 2008 bp, Homo sapiens; identical to SEQ ID NO: 2488

SEQ ID NO: 2490 - DNA, 2190 bp, Homo sapiens
  misc_feature (1008)..(1008): n equals a,t,g, or c
  misc_feature (1026)..(1026): n equals a,t,g, or c
  misc_feature (1085)..(1085): n equals a,t,g, or c
aggggcggggcggtgccggcaagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggtgattcctgtcatgggatgtgctgtgtgatgagtttgaagaataatcagtaggcmtgycagagtttgggttttttttttctctttttcttgtcatttcattgtttgtttggaaagaatcatatttcagtttagacataacaccagagttcccttctgatgctcttcttcgggtccgtgcagtggcagattccttaaagttttcttcagctttaccctatttaccctttatactgggcattggcaaatgttgtaaagggccagatggtaaatattttaggctttatggtttggtctctgtggcaaacatccaactctgccagtgtaccctgaaagcagccatcgataatatgtagatgaatgggtatggctgtgttccaggaaagctttatttacaaaacaggcagctagcccttgctttatagcaagttatgttcttctgaggttctgctgtatatgagttgacttctttagagaataatactttgttttgkttccacatttatttaggtcataagagaactgcttatgacatgtcagcaagaattagaggatttaaagaaatcaggaactcaaatattgagganctaggaaccagtttttgntatttgtattaaatcttgacttcctcttccacttaggctatgaagataattgtagctancacacagttgcttatttaaaaaaaaaaaaaaatctgtgaggcatatgtgtgtatgtatcttctctatcttccaggattcttttttaaggattgatttggtatgttttgctgctattccttgacagtatatttatttcagaggtatcacagctcatcttcccttgactgattcatcaggatttgtcttttttgtaatacagctaaatttaaatagcataaaattggataatcaccttataattgggaaaaatgcatgtgtcttcattgtagtcaatatggggcagaagcagcctccacgatctttgttttttgtatcttaggccatcagttaatttcagtgcagattttaaacacctttatttgagcacttctttccagatgaggcaagttcatgctaggtttttagggggcagaaaaattgtttggaacttgtcatttttttatagagaggaattaattcccattttaacagtagagtgttcctcaactgaggtctttcaggaattcagtaacagctaaggcctcttttgaatgcttttgtttcagaggaaatctgtgagactwcaaggaraaatgagggaaatgaaatagattctaagcttataarraarawtcrgcagtatgtgttcctgctgtatgctagacacttcgctagcggacagagacagagcagtgaaagacacagtctttgctctcattgagctagttttttatatgggagtgtgagatgataagcaaaacagatcattcaaaatgtgaycatattaagtgctataaagaaataaagcaggccaggcgtggtgctcgcgcctgtaatcccagcactttgggaggctgaggcgagaggatcacgaggtcaggagttcggggccggcctggtcagcatggtggaaccccgtctgtactaaaaatacgaagggttggccgggcgtggtgatgggcgcctgtggtcccggctgctcgggagtctgaggcaggggaatcgcttgaaccggggggcagaggtttcagtgagccaagcttgagccactgcactccaacctgggcaatagaactagmttcgtctcaaaaaaaaaaaaaaaaaaaaaaaaaaaaaaaaactcga

SEQ ID NO: 2491 - DNA, 240 bp, Homo sapiens
ggcacgagctcgtgccgctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaaaaaaaaaaaaa

SEQ ID NO: 2492 - DNA, 686 bp, Homo sapiens
  misc_feature (7)..(7): n equals a,t,g, or c
  misc_feature (9)..(9): n equals a,t,g, or c
  misc_feature (683)..(685): n equals a,t,g, or c
tgctggnanctagtgggtcccccgggctggcaggtgctccaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctgaaaaaaaaaaaannna

SEQ ID NO: 2493 - DNA, 1961 bp, Homo sapiens
gtaagttatgatacatttgaaaagtgtaacatcactgatgctccttgccataaacttaggcaatatgaaacaatcttgctcttagaaccacttcaaatgattggtaaattggggtcacttatggtaattttatttataatctttaatcttgtatctacatctcttttctcctcttccttctcttacattcagtaaatctaaggcttctttgagtttctgtgccctctcttacctattggcaatgtctataaagacacagctcacctctttcttctcttctgggaaatattattagccattatgctttcagcccacatttgttcacttattatttccctgtgtagaccctacaaaatgggaaccagatctttttctatagttttagataaaggtattctggcagttttctagagaaattcattattagaaatttattctaatgggaacccatttttggcttactctgttggttgctttgacctctgtttttccttgcagagctcgacttattaatatcatttaggagcactgggaaacatcattctgcatatttatcaggcaattcatacacacatccctacagttcagtgtataragcttctctgttttggacttaaactgaaagattttaatgactggtcgtattggcccagctcctaatatgcagatgaatcattgtgtctgcactgcggartgttggscatctttttacttctgcttttcttaagtagatgcaaatattgaggggatcctaaagaaggacaggaagagtaccagcatttttttttttctaaatctgccactaaagtccctttggattggattttagatartcatggcatttgaataacctgcatttattaatctctggaaataagtgaaaaactagaaaaggctgaacgtmcaatcaatataatgcaatactggggcctamcaaagtggataaatgatatttatcagcaggcgactgctgtttaattcacaggcacaaatgcccacattcatctgtgacactgaatcagttttcttgtgagtgttgtcttccctgaggtttctttctcttactcttctctccttgctcaaatttcagagttgtcatccacaattctgggaaaggtgatgtttcacttgcttcattcaataaagatggggtttaggggggtgacacaaggtatggctaccaatgtctaatgctggtattatatcctttatccagtatgctggggagaaagtacaatcattttgctttacttcatagctatctggttcattaaatcccatgagtcttggtaaattatgaagcaattattgattttgttgtggtcaacatcaagatatatattgattttcccaccagtcaatagtttccagaggcataatcaatattgatgtttgctgaacatgtgtgttaatgtcagtgtgtgtatatgtacttagatctctacactcagatatttattttatactctttctgaacgtttttgtaaaaaactattttctcccaaagatcctattattttttggctgatttattcagttcttcctttttgctttacatttttaatctcatttattcttccccggattgataatggaaaggaaaactaaggctttggaagaagtctatttgcctttaatgaaccggttgggggtgagtcttcctgatgagattgtgattaattgcaaagtgagtattacttcttgtctccatcctgtcggttcgatagaatgacaaaaaaaagttgaagactttcactctccattccagcatctaccagaccaacataactcagtaagcacatctgagaatccccctcatttactcccagtacttttttcaattatgtggaacatagacgaacaggtcaaacttggatttagacaaagttaaatgatcaactacatgatgcaatttaatgggcacaaaaaaaaaaaaaaaaaaaaaaaaaaaaagggcggcc

SEQ ID NO: 2494 - DNA, 2647 bp, Homo sapiens
tcccgggtcgacccacgcgtccgagaaacttcactgctatttccagatgtcattttaaaatattttagaatacctgatttctccatgacctatccatgcttttctaaggttccaaactaaaatgcagaatcttgagttattccagaacatagatttaaaatttgatcagaaaataaccttcatttaagaaatgaggggtcaggcgtgagccaccacgcctggccaccaatttttattatatgattttataactaaaatttcatgtctagcaatgaaattcttcttctctcttttttgtttatttatcttcgttttagtctttctttctcctcggatctttccccttctatctgtctcagttccttcattttccttagctctccatttctcccagcatctgctactagtctagtctcctggctcttaacctttttgagacacagactcctttaataaagtgatgaagaaagttatctccccagaagaatacacacagagaacacagaatattttgcatattatttcaaaggtaaagaatgccaagaagccaggggcagtagttcatgcctgtgatcccagtgctttgggaggctgaggtggaagaatcacttgagcccaggagttcgaggctggcctgggcaacatggtgagacctcctctctacaaaaaaattttaaaattagccaggtgtgctggcacgtgcctgtagtcccagctactcaggaggctgaggtgggtggattgcttgagctcaggaggtgaaggctgcagtgagccatgattgtgccactgcacttcagcctgggtgacagaatgagaccctagctctaaaaaacaaaggatgccaagtatctaaactttgagctccttgaggacaaaaactaggcgtttttcatcctatatgcccagtatttagttgatgtttcttgagtgtatataagtgtgcacatgcccagaaacatgtaaatattagtacatgttgtagaaaagctgttgtcaggaagatatttgtacactctggctttccactatgatagtcaccaggcacatgtgggtactgagcactggaaatgtggattgtccagattggaatgtactaattgtaaaatacgcactggattgcacaggcttggggcagtacaaacaaaagaatgaagatatctcattaatagtttttatgattattacacattaaaatgatcatatcttggatatattgagttaaaatatattattaaattaattttacctctttattgttacttttctaaaagcagctactagaaaattttaaattatacatgtaactgctcatagaaggttggtatctgggttcattcattagtggacattcataaacatagtaattttctttaatttcatggattcgttgaactaaagatcccataggtcaccgccttccctgtccctcctctaccaccaaaaattaatgagaacaaatgggaagaatttactctgcttttcaaggtactctgatacagatttttatctactgtcataagtatacctagaacaaaagcactgttgactcaagtagtttcactaatgaaaaggaagcagcagaatgactaatgtaaattggaggagactcttttatttggaatgctttggttcttccactgtggaacaggtgtggctgctgttgaaacagcagagtcatactaggcatatctgacatgtgaggaaccgcagcattgctcaggggcccctgccttccaatgaatggatgtaggatccatcatacatcagattgctcctttccaatacaaactctgatgcagaaatgcacttggtgtatttgctttttcttactttctggtttagggcagaaataatattttggcttagagacttttgtcctgaactatgacataataggatgagaatatcgtgtcaaaaatagccttacaaggtcctttttggcattaagacttctggagtgagtttgcagtggattattgagaataattctgttcattagcagctagccatctttgatgagtgctgacttctctcctttcagcacagagcaggaaatgcctgcctcccatgactctgggttggagtgaaggggaatgcataccagccaccctcttgcagaggtggggcaggtgctggcacagagcctcaggttaggccgaggggatgcaatctcagatcagcagccagcagtgtttgtaaacaacaggagggagattgtgctggtgatgtccaactcacaccaatgaagatcaaccggtttgtgctttgggcagcaggctgcagatggacagtgcctcctgagggcatcgccatgttttagggatccgtgttgcaggatacctgtctgcaagagagagtcaaggagggctttttaagcccctggggttcaggcctggcatctgggtgttaagtagagtgaatctcctgaagtccaaactaacatatgacattttaaaatgaggaaaacaaatggctctgaaaaggtctataggattataggtaagtggttaatacggaagatgttataaaggtctcaggaggagatggggtgatccagggttggttgaagtcgttgaaatggaattaccctgtcttttacctgtctgtggggaaaaaaaaaaaaaaagggcggccgctctagagg

SEQ ID NO: 2495 - DNA, 1520 bp, Homo sapiens
ccacgcgtccggtgaacgtggcatcctggacttttgcactgctcatattggtaaggtaagcaccacccctggcacacacacggtcaggcatgacataaaaagatgttgctaagggacattgaggtctatttcttgggacaagtaggaattttctatccctgttcattcttcatcttggccacacacatttgctctcttgctcatcccacagcgcctcccacaaggccacgctggatcctgccacagtgttaggttacatttccttccttctggctcaccagatgtggacctgactgggaacgctggaagctactgtccctggagccctactctcctggcttggtgcctccatggggaatgacagtgggcactctgcacccacatggaagggagtcccacaccttctaaggtctcctttgtaacctacctctggctccccactgtgccacatccctgtaccatggcatctgtgtcttttggacagcaccgggctttcaggatgactagtcagggttgtcttgtctggaccagatgctttgagggtgcagccttctgggaattccctctagggattttctatgatgctggcttccctgtaagtcccactccaggcccgggtactctgtccaagccccacagcagaagagctcttcaggggcctcatttggtgtcaactcagcaagaagtgaagtttaaagcccagagcactgcagggcattgtactggtgtaggaagggtacatccagggctccaaggtgttttctgtgctgagctcatctctcatcccccagccaccacagtgctgggtcatagctgggctgttgttttcctatggcaggcccagccctgtctagctctcagttcctctgctctgcagccagggcccttggcctgaaccctacacatagcagcactcactcgggctgtaagtattcttcagtacctgctatggcctggcatttaggaactctcaagcaacagcacaagtgaggcccctgctctcccgtgctttgggtccgttgtaacagcataaaaagcttgtggagtatcttagtgagtccactcttgcagctgggcagcatcatagtgttcggctccctgttacagtgtcatttcttggggacatagcagatggaaaattctggggtagttttgatttagcagttatcacatttgctgttcatggagtgtctgcaggggctaggcacccctcacgatgcttgtgtctgccagccatggtggctcatccctgtaatcccagcactttgggaggctgaggtggtagatcactcagggtcagaagttggaaatcagcctggtcaatatgacaaaaccccatgtctaccaaaaatacaaaaattagccatgggtggtggtgtgcacctgtagtcccagctactcagaaggctgaggcaggagaatcacttaaacccgggaggtggaggttggagtgagctgacattgtgtcattacattccagtctgggagacacagtctcaatctacaaaaaaaaaaaaaaa

SEQ ID NO: 2496 - DNA, 594 bp, Homo sapiens
  misc_feature (15)..(15): n equals a,t,g, or c
ggataatcgccagcngcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaaaaaaaaaaaaaaaaaaaaaaaaaaaaaaaaaaaaaaaaaaaaaaaaagggcggccgc

SEQ ID NO: 2497 - DNA, 933 bp, Homo sapiens
tccgaaacattttaaaagtgaaatcatgagttaattttcttttatcacttggtaattgtctgaactaagtggctaactgctcaggacatagcagatgcaccatcaagctgggcacttcaagctgtcttctagaaatgaatttctgtgctttttagcactgctttttgcttgggggtgggaaagggtggtctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaacatggaagaggaagttgttgggttttttttttttccagtcagaaatactgaaagatttcttacagctgtctggtttcctgatacttaaattgtgaaactttaagttcactccattatcatttctaaaatttattttgaataagttccctttcgggggagatacccatgtgtagagaatggtatggaaatctgccaatggagggattagaaattttgtcagtttaaagacttggaccttttgagatttttgttgttgttgttttgtttgttcttcttttctgagatgaaggctcactctgtcgcccagcctggagtgcagtgagctgagatcatgccactgcactccaacctgggtgacagatctcaaaaaaaaaaaaaaaaaaa

SEQ ID NO: 2498 - DNA, 4561 bp, Homo sapiens
  misc_feature (99)..(99): n equals a,t,g, or c
  misc_feature (105)..(106): n equals a,t,g, or c
  misc_feature (1358)..(1358): n equals a,t,g, or c
gcacaccctgacctaaagacatagccccaaatcactttcaccatgtagggtctgagcctctttaaatccatattcccgtccatccagtgttgtgcaaantgaganngagtgtgctttggtccttccttggagtcagcgtcgcctgtggccccctccgttattgtctcgtggccttttgtgctaaactcggggcctctgctgtggagtaaagaatgtgggtttgtgtccctacctctgtcactgctggttctgcaacccaggacsattctcattctactatggtgatgcccctgayttcgttgacagcacacagacrtgacttcagagttccgtgcacatgtgtgcatcttctttcccttctctagagatgtttggcatcttcctcctgctgggttgcaacrcaggctgctacagcattctcttatcttcctttgcccttacacagactccaagcccacggtagagacgctgggacccactgtgaagagcgaagagacaaccaccccctaccccaccgaagaggaggccacagagtgtggggagaactgcagctttgaggatgacaaagatttgcagctccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagcagccaggagagcaagttgctgtgggtcatccgtgagaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggnagaactacaacttcgagctctacgatggccttaagcacaaggtcaagatgaaccaccaaaagtgctgctccgaggcatgacggattgcacctgaatcctatctgacgtttcattccagcaagaggggctggggaagattacattttttttcytttggaaactgaatgccataatctcgatcaaaccgatccagaataccgaagrtakggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtratcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggcyttgaatgctaaaaagaagcagggtacgsagggctacatgtagataccacaccaaggctggaggctgstctgtcrtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagaaaaaaaaaaaaaaaaaaaaaaaaaaaaaaaaaaaaaaagggcggccgc

SEQ ID NO: 2499 - DNA, 1142 bp, Homo sapiens
ggttgacatgagtcatactttatgcggatgaagaagctgaaactcataaaacttgtccaagatgtcaaatcagaggttcagagaagagtgattactttgagtgggtgttcaggagggattgctggaggagatggttctttgatctgggccttgtaagatgggcagaagttgagtatgtggagatggtaatggccttcagaatttatgtcttatctgtttggcctggcatacaaggcctttgacaatttggcagagtctggcttttttggtaggtctccagccagctcttcactttgtttcagccacttggaaccaagccacatcgcctgaatatgcaggtatgggtgtttcagggctctgtgccttagccaagagtgtccgttctccttcacctccctcctcctacacctccctcctctttctcctgagctctttcttatacatccttgggcatggcctatatctgctttacatctcggggtcagaacctgacccatggcaagagctcagtaaatgataaatgaatagatggaggttgagccttggagaagacaagtaatgagaaaaaaaaatactttgttggcctcatgtccttcctgtcccttttggggcagaaaggctcattcacaagtccaggccaaagtcagcacaggcttcaatttcattggctcargccggtacacagatggggtgcattagagcttgatgawttaaarggttgggkgaaatgcctgamtgtkgggagarctgarggarctgtkgctggcattgcacaaagcttcctttatttcactccacagccacccccggcgttaaataatctatagattcttatgcaggtctgcctaatggaaagatcattgccccagcctcctccttggaaaataggcctttcttttcatttttccctccctcttccatttaagaaagttcaaggagagaatgtctctcctgttctcctctcttgacttaatctcctatgcagtttcagaatctgcccagtgggagttaggagctgggaagcagataactggagctggatcagcagtgtaattaaatgatactttgtactggtaatagggcctttcatctgaaagcttgacattcgtttggtgcaaaaaaaaaaaaaaaagggcggccgc

SEQ ID NO: 2500 - DNA, 1317 bp, Homo sapiens
gctcagtctgaatgatcatcttcaatattctatctagtgatggagtgagaaaattctcctgaactctgggcaggaagttcatattgctcagggtgagccaccatgataaaaataactcacacaggctaattacaattaatctaggctcttgacctttaaaaaatgtatataatgtttacatatgtttataatgtcacgccatttatttcatttaaaattttaaatgattttatctttggtcctctcttacaacttattcttggtacaacttattctttgtactataacagcagagatgagtaattgggacagactagcctccaaagcataaacttatttatgatttggccctttacagtaaaagggccaaatcataaataagtttatgcccacgcgtccgaacttatttatgatttggccctttacagtaaaagtctgctcatcccaggttttgcttgtcaatttatatactggcgtttgttcctgatcctatttatttatttctggcatccaactctggtagttctttctgaatcagtttaatgaagtttgtaaatgatgtaattaaacgttatttattacttttatttttttctagagatagggtcttgctgtgttgcccaggctggtcttgaactcctggcctcaagtgattctcctgctttggcctcccagagttttgggattacacgtctgaggcattgcactcagacacttttatctaaagtttatatactgttaaactaaagaaaccatatacaaatttcaagtcaggtgcttttactcattttataccttgattcttgaatggccagattttctgaaaatacccagttaatgattagattatgctacttcagtcaccacgtgtttgaaggctgatcacagaaaactagaagcaatgtaactagtttcaaaatataattaaatggaggaggaagtgtttggcttttttccctccagaccacaaattggtaggtaaagtaaaagttagatttgaaaattgggcckgggtgtggtggcttacacctctcagcacgttgggaggccaaggtgagtggatctgttgagtcccagagtttaagaccagcctgggcaacatggcaaaatgccatttttactaaaaatacaaaaatgtagctgaatgtggtggcgcatgcctgtagtcctagctacccaggaggctgaggtgggaggatcatctaagcccaggaagttgaggctgcagtgagccatgataatgccactgtatgccatcctgggcaatggaaatgagagacccccgtctcaaaaaaaaaaaaaaaaaagggcggccgc

SEQ ID NO: 2501 - DNA, 420 bp, Homo sapiens
  misc_feature (2)..(2): n equals a,t,g, or c
  misc_feature (21)..(21): n equals a,t,g, or c
  misc_feature (34)..(34): n equals a,t,g, or c
  misc_feature (93)..(93): n equals a,t,g, or c
gnaacagctttacccactagnctttggcaaaaancttatttaggtgacactatagaaggtacgcctgcaggtaccggtccggaattcccgggntcgacccacgcgtccgggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaagggcggccgc

SEQ ID NO: 2502 - DNA, 1506 bp, Homo sapiens
  misc_feature (312)..(312): n equals a,t,g, or c
  misc_feature (323)..(323): n equals a,t,g, or c
  misc_feature (416)..(416): n equals a,t,g, or c
  misc_feature (447)..(448): n equals a,t,g, or c
ggaaaagttttattgaattatagttttttatattctgttctcttgctttggttttcttttttgtgggaactcctgttgtatgcatgttcgaggttcgtttcttgtttctaatatttgttgccttctcttgaattattttttttcttctaaaagtttgttttcattgtctgtttctcttacattatgtattgtgtatattgactcttatgtttctccttagtcttcttcttaaaatgattcattttatagccaattccttcctgagttccatcagctcatttctgagtgtttgtcactccgatttatgctatncttcgtatctngtagcaatattaaaagtttttaaaatgtgaaataatagataattcatctttgtgtgtatgattcttaccatgattcggtaagattcacttctngtagaagagttactctactccttatttaaannctyttttttcttgtaataactttatgtgtgatttggcttcagtccttttctattgctcatttttccatgaaattgatttttctaaacacttagcttgatttaagacttactaattttatggttcttagctctctctcgtatttggaagtgttcagaaacatggctgcttattttctgagatttctttcctttattccctcactccactttcaaaattaccctttcttaaagtgtactatttggtgttttttagtatattcacagagggagaaaccattaccactatcttattttagaagatatttatcacccccataagaaaccccatacttattaatagaactcctcattcctcacttcttccagcccctggcacccactcatctaccctctctgtctctagatttgcctatgttggacattggatataaatggaattatacaatatatgatcttttgtgactggcttcttttacttagcataatgttttctaagttcgtcattctgtagcatgtatcagtatagtcatttgctgcataacagagtttcagggccaggcacagtagctcatgcctataatgccagcactttgggcggctgaggtaggaggatcatttgagcccatgagtttgagatcagcctgggcaacwtagtgagactacatcagaaaaaataaaatagacaggcatggtggcacgcacctgtggtcccagccactcaggagggtgaggttggaggattgcttgagtttcaagaggttgakgctgcagtgaggtgtgatcgcaccayttccagcttgggcaacagagcaagacaccytwtctcaaaaaatctaaaacgaacaaaaaaaaaaacacgacatttcagtcaacagtggattgcgtgtacgatggtggcaatttctatcacctagtaacatcatagaccttccaataggataagatgtggaggtggaagatagtgatattgatgatcctaaccctgtataggcttaggcttatgtgtgtgtttctgtccgtttttagcaaaaaaaaaaaaaaaaaaaaaaagggcggcc

SEQ ID NO: 2503 - DNA, 1424 bp, Homo sapiens
gatagaatcatcactgcataggagccaggaaatttagtttccagtcccaggtagtccttagctgtataatcggaaaaagttactttgcctctttgggcctcaatttctactaattctatgatgacacagttggacttagaaattttaggatgctaaggactgacttaataaagctttcctggtatctcagacattttttaaaaggctgtatatgagtttgtgtatatgtgtatgtgcacatgcatttctggaaaggcttcccctccaaccattaaatatataattaagttataaatgtgttgtttataatgagaaataaataccacacttgacaatgtctatttccaaagaattgggtatttttgtgcttttgtttattcctggtattttcatatcatcctgttacacacgtgagcagagaatgtgtgtatcatccatatttaatttacagtcatagctagactaagttattatccaatgttattgaaagaatcagtagcacagatagaaatgaattagttcctagtatacagttttcttggcctttctcttaaccagtttgctttcttagagaaatgaactgatctgactatgattaagatcatttattgctagacagaagtaaaattagagattatccatagaacattttaatcttgtaatttatttggtgtgttgtagaacacctgacttttctcattgtatttggtaaatgtgttaaaaatgttaagtcagtgttatctggttttattttatctcttgagtcatgtttggcatgtatgtgttgggggggtgggcataggagttacacatttaagaaagccctatcttttagtagaataaattaatgcagattggcctgtcttcctgcctgcctggtcagtaacagtggactttggagattgatctagtgatgataaacctattgtatgtggcataagccagagaagtcagcttcgatagcaagtttctacattggcgtgagagagaagcatttagttaacatttcaaagtaactaagcctgttagcatccatgtattctatcagtagactttattgagtcctgtcatttgtatggtcttttattgttttttgttttcaacaaaggaaatagcacacacatacatctcaaaatggattatacctgttgtaatctcagtattttgggagatcaaggtgggaggatcacttgaggccaggaatttgaaaccagcctgggaaacatactgagatcctatgtctacaaaatttttaaaattagccaggtacagtggtatgcacctgtagtcctagctactcgggaggctgaggcaggagaatcacttgagcccaggagttcaaggcagccagtgatctgtgatcaaaccactgcactccaacttgggtgacaacatgggaccctatcttaaaaaaaaaaaaaaaa

SEQ ID NO: 2504 - DNA, 1348 bp, Homo sapiens
ccacgcgtccgattttctgtgaattttgggaagaagagagttaaatggaagaaagaaaaaaaatcttgcaaatacctttaggatagtagtttttttggatacagtagacattgtttgaaatgaatgattaaagctgtacttacctttcttaaaattcactgcttgggatgggctggtaacagtttcgaggttactctcattaggcttcagtgttaagtacactataccccattttcttgggaagtgaacagcaacatctactctgttaaaatcattatacattgtgtctgctttcagatttcttccttttagtaattagtgttgtgtatgtgttagatttttttttgtctttactgaaacacaccctttggaattcctttagcgaatatgctcttttgggtggataacctaataagctttcctctttgagttttctgtttttttactcagcacagccatggaagtagggatttaattttctgtcaaactctgcatctcacaaagcaatagttactcaaaacacgactttcaagaaggttattctttttaagctttcagcagatgagctgagtagcagcaggaaagcaggtattgagaactgtcttggtttttgtactgctgttgagtagtaacattgcagctgtcttaaatcctgaatgacacagaagcttatggctggtcgtactacatagcaccttgaaagtgacagggcttttcatttctatctgatttctgtttttcaaaaataaaactccttattcttttcctatcattgtaaatattcttcagcttcctatcactaatacatagtctcggcattagagaccagttaaaataaataggctgaggaaaatcttgatagtaggagagattttggagcattcattaaaagtaaaaatagggctgggcgtggtggctcactctcccctgtattcctagcactttgggaggccgaggcaggcagattgcttgaggccaggagtttgagaccagcctgggtcttaaaaggtagatattattctcattttacagatgacgaaactggagcttgtttgaaaagtttgcccaaaattgtagcagttagcgtgaggggcctgcctctagagaccatgcaaattcaacactaagctatactggactggtctcacatagtgagaccctgtctctacaaaaaatagaaaaagtagccgggcatagtggcccacacctgtagttccagctacttgggaagctgaggcatgaggattacttgagccaaggagatcaaggatgcagtaagccatgaccatgccactgcactcgtgcctggacaacagtgcaagaccctgtctcaaaaaaaaaaaaaaaa

SEQ ID NO: 2505 - DNA, 849 bp, Homo sapiens
tcgacccacgcgtccgaaagaatcttcctcttgctctctttttctttcctacccctcacttcatctgtttccctgatttttgactctcccctttccagtcatttctttcccacccatccgcagtcctggaaacatttattttttcttttgcccactgttttcatttgctcattaaattaaaatgactgctcggctcattgggaatccacatccccaagttagactggggatatgctctctgtactgtctccttctatggaattccaccccacccagagagagatgacttcacagtttgttcatatgagcatcatcccatgtcgtccccaacccagggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaaaaaaaaaaaaaaaaaaaaaaaaaaaaaaaaaaaaaaaaaaaaaaaaaaaaaa

SEQ ID NO: 2506 - DNA, 1519 bp, Homo sapiens
ggcacgagggttaatggaatcacgtggtatgtatctttttgagagaggccttttttactctgtataatatccttgagattcatccatgttgttgtgtgtttcagtagtcatttattcttatttccggtagtattccatgctatggatgtaccacagtcgtgctctttttgttaatagaactaaagcaactctatggagctaaggtaactgggtacagctgagtagtgatttaaagtttctggagtgttttcagaaataccatctcacctctaacaaggcgatctcaagtcacttatttgggaaaacaaaattacgaagatatgatttctttcattgttgtagaaccattaaataagtcatcagattatgatttgaacccagggcacccagtcaagtgctctttccctatgcggccttagctacggggatttacatttacagttgagaagtgaaacaagaaaaatttgtttttgaaacataatagtaccatctagcctggctgaccaacccttccccagcaccaccagtggacatgcgcatgtacatacacacatacatacccacactttaggctgagggagaatcttgtctttttgaatagccttcatagtaacctctgggattcaagggtacctgatatttaagacctttattaaaccttggttcagtggttttcaaacatttttgaatatcagaaccccttttcctaatggactgtttcatagaaccccaaaatgtgtaacaggtaacagcaatagttttgaaagttcaaaatggataatctttacttgtgaggtcggacatgtgaatggtgggcatattcccatgattctaatatgctgtcagaattatgagtgacagacagttgctgacttggagcacttcagtggctcatttgtttttctctatttggttatacaacagtgagacaagcgtgatgcacatggccattgtcagggtgacttttcctgaacagcatgctgtgtagttactttgattaatcagagatgggaggacaagctccgttttgaggtcaacataatactgagctatcctagcaatacaaaattatgtgtggtggcgggcttcattgtcttaacatatggcttggaacatgtttgagtgtgcatctttttttttttaattgtcctaccttaaaaacacacacattttgcagactctctgaagccctgtggactactattagataattgttggttgggcatgctgtaatcccagaattttgggaggcagaggcgggaggattgcttgagcccaggagttcgagaccagccctggaaacatagcaagatcctacctctacaaaaaaattaaaaaattagctgggcatggtgatgcatgccagcagacccaactactccagagactgaagtaggatgatcacttgagcctgggagttcaaggctgcagcgagccctggttattctgttgcactccagcctgggtgacagaatgagaccctgtccccaccctcccccccaaaaaaaaaaaaaaaaaa

SEQ ID NO: 2507 - DNA, 1292 bp, Homo sapiens
cggcacgagctgggattacaggaatgagccaccatgcctaacgagtataaaatattgttgattgtgatgtttcatgcacgtaagttttcaattttgatgtaatcttgctacttgtcatctttgcttttgtttcctgtacttttgtgtcatatccaatcatgtgtattatatatatatatatgcacatacacacacatatatatatatacaacagatatatataaaatgaaatattattcagtcttaaaagggaaagaaatcctgtcatttgcaacaacatggatgaacctggaagacattatgctaagtgaaataagccaaacactgaaaggcaaatagtgcatgatctcatttatatgtagaatcttaaaaaagtgaaactcatagcagcagagagtagattggtggttcccaggggcccgagagaggaggtaataaggagattttggtaaagggtacaaactttcagttatgcaaaatgactaagttctggagatctagtgtagagcatagtgactataatgaacaatacagtattgtatactaaaatttgctaatagagtagatcttaaatgttcacacacacacactcacacatgaaagaaaatgataactgtatgaagcaatgatatgttaatcagcttgattgtagtgatcattttacaatgtgtacttatatcaaaacatcaggttgtataccttaaatatatatgatttttatttgtcaattatacctcagtgaagctgaagaaaaagaggggaaagacttaatgatattggatttggcaatgactttttggacatgacagtaaaagcataggcaacaaaagtaaaaatagataaattggactacatcaaaattaaaaacttctttgcatcagaagtcacaatcaacaaagtgaaaacacagccatagaatgggagaaaaaactacttgccaaccatagatctgataagaggttaatatccaaaatatataaagaactcctgaccttgtgatctacccacctcagcctcccagcactttgggaggctgaggtgggtagatcacaaggtcaggagttcaagaccagcctgaccaacatggtgaaaccccatctctactaaaaatacaaaaattagctgggcatggtggcgcatgcctgtaatcccagctactcaggaggctgaggcaggagaattgcttgaacccaggaggcagaggttgcagtgagccgagatcttgccattgtactccagcctgggtgacagagcaagactctgtctcaaaaaaaaaaaaaaaaaaaaaaaaa

SEQ ID NO: 2508 - DNA, 1292 bp, Homo sapiens
ggcacgagctgggattacaggaatgagccaccatgcctaacgagtataaaatattgttgattgtgatgtttcatgcacgtaagttttcaattttgatgtaatcttgctacttgtcatctttgcttttgtttcctgtacttttgtgtcatatccaatcatgtgtattatatatatatatatgcacatacacacacatatatatatatacaacagatatatataaaatgaaatattattcagtcttaaaagggaaagaaatcctgtcatttgcaacaacatggatgaacctggaagacattatgctaagtgaaataagccaaacactgaaaggcaaatagtgcatgatctcatttatatgtagaatcttaaaaaagtgaaactcatagcagcagaaagtagattggtggttcccaggggcccgagagaggaggtaataaggagattttggtaaagggtacaaactttcagttatgcaaaatgactaagttctggagatctagtgtagagcatagtgactataatgaaccatacagtattgtatactaaaatttgctaatagagtagatcttaaatgttcacacacacacactcacacatgaaagaaaatgataactgtatgaagcaatgatatgttaatcagcttgattgtagtgatcattttacaatgtgtacttatatcaaaacatcaggttgtataccttaaatatatatgatttttatttgtcaattatacctcagtgaagctgaagaaaaagaggggaaagacttaatgatattggatttggcaatgactttttggacatgacagtaaaagcataggcaacaaaagtaaaaatagataaattggactacatcaaaattaaaaacttctttgcatcagaagtcacaatcaacaaagtgaaaacacaagccatagaatgggagaaaaaactacttgccaaccatagatctgataagaggttaatatccaaaatatataaagaactcctgaccttgtgatctacccacctcagcctcccagcactttgggaggctgaggtgggtagatcacaaggtcaggagttcaagaccagcctgaccaacatggtgaaaccccatctctactaaaaatacaaaaattagctgggcatggtggcgcatgcctgtaatcccagctactcaggaggctgaggcaggagaattgcttgaacccaggaggcagaggttgcagtgagccgagatcttgccattgtactccagcctgggtgacagagcaagactctgtctcaaaaaaaaaaaaaaaaaaaaaaaaa

SEQ ID NO: 2509 - DNA, 935 bp, Homo sapiens
  misc_feature (691)..(691): n equals a,t,g, or c
  misc_feature (806)..(806): n equals a,t,g, or c
  misc_feature (861)..(861): n equals a,t,g, or c
  misc_feature (868)..(868): n equals a,t,g, or c
aattcggcacgagctatattcttcttgatttctagccttttattggctctcagattgccagagttgggactcaatagtaagtaaccattttkttgaggtggtagtgattctaccagggtgagtwatcatgacagcagaatcactgcgtttttytctctactctgtggcatagactctatgccatagagtgacgtgtgaaaggcttgaggctccctacctacgagacaccctggtccattctagcagtatggcacgtgctgactgggttttgagtctcttgctgtataatcacattactgcacttccctgcattttctcatccaaaaatggggattacctgctttgtggatcggtttgcagatgaaataacacacgcagggtatctagcacggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagnaattcagagtcaaatttggcaaataatatatccctgtcgttttgttttttctttttaagacttgggccgggtgtggtggctcacgcgtttaatcccagcactttgggaggctgangcaggcaaatcacctgaggtcaggagctcgagaccagcctggccaacatggtganaaatacnaaaattatccaggcatggtggcccacgcctgtagtcccagctactcgggaggctgagacaggagaat

SEQ ID NO: 2510 - DNA, 2180 bp, Homo sapiens
ggcacgaggttattctagttatacattcgtctaaatttttttcaaagttttcaacttctttgcctttggtttgaatttcctcctgtagcttggagtagtttgatcgtctgaagccttcttctctcaactcgtcaaagtcattctccgtccagctttgttccgttgctggtgaggagctgcgttcctttggaggaggagagacactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactacagactctgtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccagggtcaggggtcagggacccacttgaggaggcagtctgcccgttctcagatctccagctgcgtgctgggagaaccactgctgtcttcaaagctgttcagacagggacatttaagtctgcagaggttactgctgtctttttgtttgtctgtgccctgcccccagaggtggagtctacagaggcaggcaggcctccttgagctgtggtgggctccacccagttggagcttcccggctgctttgtttacctaagcaagcttgggcaatggcgggcgcccctcccccagcctcgccgctgccttgcagtttgatctcagactgctgtgctagcaatcagtgagactccttgggcgtaggaccctccgagccaggtgtgggatataatctcctggtgaaccgttttttaagcgcgtcggaaaagcgcagtattcgggtgggagtgacccgattttccaggtgccctctgtcacccctttctttgactaggaaagggaactccctgaaccccttgcgcttcccgagtgaggcaatgcctcgccctgcttaggctcgcacacggtgcgctgcacccactgtcctgcgcccactgtctggcactctctagtgagatgaacctggtacctcagatggaaatgcagaaatcacccgtcttctgcgtcgctcacgctgggagctgtagaccagagctgttcctattcagccatcttggctcccggatccagaaatatgttcttaattatatggtggcgtgcttgatgtttgggatgcaattcccttgtctttgttttccttgatctctcttataagttttatttatttatttattttattttttattttattttgagtcggagtttcgttcttgttccccaggctggagtgcagtggcgtgatcttggctcactgcaacttccgcctcccagattcaagtgattcttgtgcctcatcctccctagtagctggattgtaggcacccactatcacacccagctaatttttatatttttagtagagatagggtttcgccacgttggccgggctggtctggaactcctgacgtgaggtgatccacccggtcatctaaagtgttgagattagaggcatgagccaccgtgtctggcctcacataagttttagaataagttgtcaagctccacaaaaagtcttgctgggtttgtgattggaattacatttaactcataatttgtgttaactaatattttccaatgcatgatcatagaatatctttgtgttcagttcttcttttttgtatttaaatgcatttttaaatcctcttgaaaatcattcggccgggtgcggtgctcacgcctgtaatcctggcacttctggaggccaaggcaggtggatcacctggggtcaggagtttgagaccggcctggccaacacggcaaaactctgtctctactaaaaatacaaaaaaattagctgggtgtgctggcaggtgcctataatcccagctactctggaggctgaggcaggagaatctcttgaacctgcggggcggaggttgcaatgagctgagattgcgccactgcagtctagcctaggcgaaagagtgaaactccatctaaaaaaaaaaaaaaaaaaaaa

SEQ ID NO: 2511 - DNA, 948 bp, Homo sapiens
ggcacgagcaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacsgtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaaa

SEQ ID NO: 2512 - DNA, 844 bp, Homo sapiens
ggcacgagtttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaaaaa

SEQ ID NO: 2513 - DNA, 608 bp, Homo sapiens
aattcggcacgagctgaggaggtataccatgtaaagttggcctttactgagattcacgttttcaaaatgcaagcacttcaaacagcatgtttctttttcctcttgttagctcaaccttttcaatgaacaaaaaaagctgcacagagtttctgattggttttataatgagatcattatcctagcttgatcatgttatagaaaccactttccagtccataaactgcaatgtagaactgaaagtcttgaaagaacacaccggaacagtggtcagcctcctgatgattgattctagtcttctcacctctttggcagcaggttctgtgaggtgactgttacaggaagagcattgcaatctgtaagctcagctatttggtctgtttctagagatgtgaaaaaagaaaacaacaacaaacgtttgagttattttttcccccaaacagggactctgtggtaatttcattattggtagttgcaaaggaaaaagcactcaaatgaaagaaattaatgtccaatttgcctttcagtggcccgaagcttatctgatagccattgcaatcgaatgaatggatgacttttaaagagaaaaaaaaaaaaaaaaaaaactcgag

SEQ ID NO: 2514 - DNA, 1595 bp, Homo sapiens
  misc_feature (1284)..(1284): n equals a,t,g, or c
gcgccgcggcccccacctctgcctccttctactcgggcgccccggccgccgccacctctccccagcccaggagaggctgcggagccgcagccgcccagaccgcgcagcggggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggacagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttnctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaaraawraaaaaaaaaaaaaaaaaaaaaaaaaaaaaaaaaaaaactcgag

SEQ ID NO: 2515 - DNA, 953 bp, Homo sapiens
ggcacgagcagaattcctgttgggacaagagtaggaagaggcaagactgaatgagtggtcctctgcatggacaccactcactcctgaggctgctggcagcatgtaccctcatcctgcctcactccttagcagctagtgtgaacgtgaagaattgagaaatatagtgatcacatcagtgtgtattcattctggtcagcaaactaggcatatcttaagttttttaggaaatcactgttggcctccttttgtgtatcatagtgcaaaacagttttaattagttgaattattatagatacacaagaatttagaaaatgcgtctgggcgtggtagctcacacctgtagtcccggcactttgggagtccaaggcgaatggatctgcttaagtccaggagtttgagaccagcctgggcaacatggtgaaaccctgtgtctacaaaaactaccgtgtctacaaaaaaattagccaatcatggtgttgcatgtctatggttccaactactttgagaggctgtggttggaaagatcacttgagcccaggagttagaggttgcagtgagccgagatcacaccactgcactccagcatgggcaaaaaaaaatgagactcttgtttaaagaaaaaaaaaaagagtttagaaatggccattacgggccgggcgtggtgctcacgcctgtaatcccagcactttgggaggctgaggtgggtggatcatgaggtcaggagatcgagaccatcctggctaatacggtcaaacccmgcctctactaaaaatacaaaaaatcagctgggcgtggtggcaggtgcctgtagtcccaactactcgtgaggctgaggcgggagaatggtgtgaacccgggaggcagagcttgcagtgagccgagattgcgtcactgcactccagcctgggcgacagagcgagactccatctcaaaaaaaaaaaaaaaaactcgag

SEQ ID NO: 2516 - DNA, 1320 bp, Homo sapiens
ggcacgagccaattaacccagaagtgtttattgaagatactttttcacctgttgcatttcaggggcacctttatatgtgtgtgtctgtcttgtctatctttgtgccccagctacactgccttaattatagtagttttgtgagtctcagtatctgatagttaaatcttccagctttattcctcagagtgccttggccattctttttttgtttgtctgtttcaaaaaaaaaaaaaaaaaaattccagagtctagaaattcggtcatttttctctttatgtaaggtaagaattaagaatcctcacatctgcaaccaaaaatacaagcctggtgtgtaacactaaagggtaaaacagggatagatataagctgttatgctattcttcaggcaacactgtggataagtgacattcagatgtttactgtaaagaaaaatttgaatacatttgtattgaagggcttttagaaaagagcattactacacagaactgagagttgaaaatatgaaggtgtggaagattaagagaacgcgtttactttaaaagataatttaaaagttatctttccaggctgacacggtggcccactcctctagtcataacactctgggaggctgtggtgggacgatccctcgagcccaggagttcatagaccagcctgggtaatatagggagaccccatctctatctaaaattttttttaaaagaaaataaatatctttacagttatttttcttagtcctatgttctttattttggtgttttccattggatacctgcatgccaagtgttgtgctacagtattactgaagagtataatggaagtaatgtcctgctgaaaattttctttgagatattaatcattaataatttatatattgctatttaatacttacataggtctttagccttttaaaggatttctgtttgacagcttttataattgaaagttattccatttttttttaattttgcatgcttgaaaaagatgaaaacagtgatttaaattatgaagtatggggccaggtgcagtggctcatgctggtaatcccagcactttgagaggctaaggcaagtgggtcacttgagcccaagagttcaagaccagcctggccaacatggtgtgaaaccccgtctgtactaaaaatacaaaaattagccaggcgtggtggtgcatgcctgtaatcccaggtacttgggaggctgaggcacaggaattgcgtgaacccaggaggcagaggttgccagtgagccaagatcacatcaccgcactgcagcctgggtgacagagtaagactctgtctccaaaaaaaaaaaaaaaaaa

SEQ ID NO: 2517 - DNA, 617 bp, Homo sapiens
ggcacgagcaaggccgtagagctggtgcgtgcgggtagcggggctctccgaggagccgcacgccggcggcaccatggtccacctcactactctcctctgcaaggcccaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgacttcagtgagcatagcagtgggaacaaggtcaaggtccttttgaaacactgcagcgatcttaattttgttagatttggagttcaataaatggagtatcctgaaaaaaaaaaaaaaaaaaaa

SEQ ID NO: 2518 - DNA, 536 bp, Homo sapiens
ggcacgagcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgaaaaaaaaaaaaaaaaaaaaaaaaaaaaaaaaaaaaaaa

SEQ ID NO: 2519 - DNA, 451 bp, Homo sapiens
  misc_feature (6)..(6): n equals a,t,g, or c
  misc_feature (27)..(27): n equals a,t,g, or c
  misc_feature (34)..(34): n equals a,t,g, or c
  misc_feature (434)..(434): n equals a,t,g, or c
  misc_feature (437)..(437): n equals a,t,g, or c
  misc_feature (447)..(447): n equals a,t,g, or c
tcacancacactcccctctttaaagtnaacaaangctgcagctcgcgcgcctgcaggtcgacactagtggatccaaagaattcttttttttttttttttttaactttaagttctgggatatatgtgcagaacgtgcaggtttgttacgttggtatacatgtgccatggtggtttggtgcacctatcaacccatcatctaagttttaagctctgcatgcaataggtatttgtcctaatcctctccctccccttgacccctacccaccagctggcccaggtatgttatgctccattccctgtgtccatgtgttctcattgttcaactccaaaaaaaaaaaaaaaaaaaaaagaattcaaaaagcttctcgagagtacttctagagcgaccgcgggcccatcgattttccacccgggtggggtaccgggtaagtggncanttttcgcggnagta

SEQ ID NO: 2520 - DNA, 272 bp, Homo sapiens
  misc_feature (271)..(271): n equals a,t,g, or c
attctctttttttttttttttttttaaaaatttgtcagtatgtgccttatggcccagaatgtggtatatcttcatgaaagttccatgtgaactcaagaacaatgtgtaatctgcagttacgagtgtagtagtctataatgctcattatatacacttgaagaatggtgttgctgagtccagctatgtctttacttattttctgcctgccagctctgtccatttcaaaaaacaaaaaaaaaaaaaaaaaaaaagaattcaaaaagcttctcgng

SEQ ID NO: 2521 - DNA, 1346 bp, Homo sapiens
  misc_feature (14)..(14): n equals a,t,g, or c
  misc_feature (19)..(19): n equals a,t,g, or c
ttgcagaattggcncgaanaaaagcagtactgactctggagttgagcagatgtgggttcaaacccacatgtacatgtgaccagcagtgtcatcaaagagagttctgcatttctctgagcttcagttttcctcctatgcaaagaggggatcacatctactaccaagatgcaaaacagttagtacaaaatgactgctcgcagggccacatttatactgtggatgcattttggtcatattttggtaacataatctgatgtggctgactgtgtcatggcttcatacctttcatgctttggacttttgtgctttctgcaggaacgattccaggtgaagaatcctccccatacatacattcaaaagctcaaaggctatctggatccagctgtaaccaggaaggtaagatggatttgtttccactctttgttattgcttccttattagcgagcagaatcctcctgcattggaagagaccttccttcctctgcattagagcctctgccagagcctccacaaaaaacaaccttgggagaccaacaacgtaagaagacaaaggaaaaaaaacaaccttctcacttgaagatgtgtataaaagttctttcctgacatgagagtcacgtacctctgatggttgttgagtcactgctatttccaattacatagggcagtgagtgcattccagaggtattcaggctcctagaagagcaggctttgcaaagggaatacttgcctttcagttttttatgccttggtgcatttccagagaccttgaaaaatcactgggcctttgtcatcccagctgtgcactcacatcctgtgttgatgcttttagcagctcccccctactccccccaacccctgcccctggcctgagaaggtaagtagagaatagctgattccattctcaacagactctccccttttacaaacaagccctgctttgtgcagccacacaattggtttaaactgatgcctcgtggtaaagcatgtagcctggcacggccctgtgggcctgaatcagtcctgggatgtctcagggcagagctgtccttgctcaagatgggtgaaggggtgctttaccagatagcatttgtttttccattgacctacaactcctgcttttaaggctcctgcgaaaatctctcaggctgattctctctgktgkttcagtgtgtgattcttgagaaaagaatggtatactttacctagttagccattttcagggctcttgatgcttgcattaaaaaaaaaatctttttctttatcttctactctaactcttcctcccctcaccgcccaccccccgaccaaaaaaaaaaaaaaaaaaaaaaaaaaaaaaaaaactcgag

SEQ ID NO: 2522 - DNA, 638 bp, Homo sapiens
attacgccaagctcgaaattaaccctcactaaagggaacaaaagctggagctccaccgcggtggcggccgctctagaactagtggatcccccgggctgcaggaattcggcacgagattaaccatcagtctgggctgcaacagaggaaaagcagtgatttggcagtgccaatgggactcagatgggtacccagctcctttttttgctatgctcaattttaatccccctatgtgtggagttggactacatattcttgaagcagtcttccctaaataatcttgtagtctagctaatgtcaaatgtttaattggcaatgagctgaaattgcctctccaacaagggcccatttggatgccacttgttctgtgctgccaggtagatctatgtccatgtgctttaacaggcagttgagtgtggagagggatgacaccctctcttgggaataaaactgaatatatgccacgccaccttcccttagagtagagttgatggaatccctacaggcacagccaagagccttcttagacaaggcattttgctgttgttcttttaatagtctcgggtctttatttgactcaaaccgaacactgcacgtctctcatatttaaaaaaaaaaaaaaaaaactcgagggggggccc

SEQ ID NO: 2523 - DNA, 923 bp, Homo sapiens
ggcacgagctacagaccacatagcctgggcaccagagagaagctgctggcgtcagcggccccttctgtggctctggcctccatgcaccgagcagctggacacctgtctgtgcagggaatgacttgatttaaatgacataaaacgacaccaaatggtagaatggacactggcggtgcttgtctgtcatctctttcttattctttatttgtttctgttctgtgagaattgcctagtggtgtcatgctgaacctgcctctctgtgtaggtggcctttcttcagtgagtatttgcgaaagtgttgggaggtagtgagagtcgttgcatctttttctggcacttccttggtgggaccagccacttacgtgcaccctgaaagtcaagacgctcgtcccgtcttccccctcggcggttttcagtaagcgagcgcgcagttgaacgtttctcacctgaacaagtccccttcgtcatgagacggggcggctataacattgccaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttaaaaaaaaaaaaaaacaaaaaaaaaaaaaaaaaaaaaaaaa

SEQ ID NO: 2524 - DNA, 1957 bp, Homo sapiens
ggcacgagtcgcatttccagacacagcagaaggatgcacttctggttgattctccttgctgttgtcatgaccaggagaattctggtccacatccattcttaattggttgattacatttgatccggaggccatgaaattggccagttgattataccctttcagaatggttctctttgggaactgcagtctggtgttacactggatggggagtttccttgtggtttttactccttctacagaaatgcacttctttctcccaaagcaagtctccttcccattgtccctcataactcttctttggccttctctcatattgcagaagatttccaggttataacctggaaatttcattacttaggaacagggccctcatggggactaagaatcatcttctgctgtgggcccttcagagcaggttcctgcattccaccctcagctgatccatagcactaagaagacagggggctccctgacatgagctttcaggatgaggtaaggggagggtctgcagcatcccaatcatttcatgcagcagctgcttgggcccaagctagctgtggaacagcaaggatggctctgtttgaagggctgatgaggaaggtctagcctcccatgtgaaagctcaagtcaccaggtggcctctcttgggactgatgttctttgagcatataccatttttctagcgtataatgttcttggttacaatttatattgactcagctgcaggcactctgctgacacagctgtgttgtcatctgaagattgttaattcctcatataaatgtaatgatacacacatatagctttggtctgggtctgggtggaaaaaaagtgagcaagtgccccctctctaaaattacacaggagccataaacccgcggtaggaggctattactaaatctagacatctcgtactagttaatgctttgctagctaggccttaaatcatgccactcatattattctctcacttacaccccttctacaaattcactatccttcaccccgcccctgaccacttttcccttctagggcacactccagaaatgcagccacagcaatatttcttatgtatattacactgcaactttgatatttgcttaataaaatttggcaacacatggtccgaagtgcttagttttcttggggcactttctaagtgatttgtacctctgatttgattattcagtccacaaaaaatctgctctttagacctgtctagagcatttgcattcagtctcttttgtctctggggaaacaagtgagccttaggccacagaagatgctctaatttgcccatccctttatgataacaagaattagccagccaaagactggaataaagcaatcctacttatttcttattttaccatgaggataaaatgatcacatgcaaaaaaaaaaaaattagcaaggtatacactgcaaacaagtttcggggagacagagaggggtagaagattgtggtttcatttgcgaaattattatgctcatattttccagtttggttaatccacacttaccttactttccctgttcatgttcacattagtggggttattttctcaggatgcaagttatagatagtccatgcaagtgttttcttaggtaacctttggatctaagtagcatgaggtcatgattgctcaattcacatatgaagataataggagtgagaaaatggcccagaattaagggcagttaaacaaaaagttaattgtgaagaggataagcttatgcagcccctttcctgaactttcctaaatccgttttattatagtgcccttttattataaagagaaaacttctctgtaggctttcaaagatcagagctcttcagtcccggctatactaaccattatttaaccttaataattagaagtctttctctccatgcacttccttccactggggactttatgtcaacccctgcccccaataaaaaaaaaaaaaaaaa

SEQ ID NO: 2525 - DNA, 1870 bp, Homo sapiens
gggagcctcaggcacttgaaactcacctcgctgtcccttttctttgccacttatttatttatttattttacaaatgaaatttaaaaaacccaaggccaaagtgggaaatgacttgctcaaggtcatccatattcctaaccctccttttactggggcatagggcaatattttccaatatgcctgaaaagcttaggtctctaatcacagataacttacagcttttcacaagcaagagttttggccaaattatgccagttaaggaatgtaaattttataaatgatgaaatactgcaaccaattagtgcaaacaaacatttattgtgaaatattcatcctaccctttattaggtattacatcatcaaagcactttgtggcaatgaaaatagctttttttacccctctaattcacccaatattccattaaagctgcaaaaaatgtgcaatctgcttgaaaaataggttgctcttatttactcatttgtgaaaagtcaaaaattaaaaaagaaaatgatactagcatacagggcctctagagccaattcacctttccatttcccaactactccccaaaataattaacaaagataatttgttttaaatgcctttttataaaaccaatgcacctttccccatattataatcatacaaattttaaaaagccgttatttactttcttggaaaaaaggtggccagccgttgttttttgattgggagcatgtgtatttcctgggagttcactttctttaactttatgctccggtttttgatgggtttcctaaggggctctgcatttcccatggactcttccccttggctgttgatgtcatagccctgaagcacggagtcttctcttttgaaggagaagtttttggtggacacccctgagaggcctttgatcttgccacagaatatggtaggcacagcatcttcgacagagacaatgaccttggccgcctgggactcgcccaccatctcaatgttattttcagccttgacttcgccgctggggtggttgggctggctgagcatctcggtamgcatcactgctgctgatgtgactatccatcatggctggggcctcatgggacgtggcaggggcaaaagaaatttccatgccactgggaagtttctccatcactgtgtgacctgagctgtccactgatgcaccactgtcatacagtgtctcagggggaggctcggatttccggtgggctgccactgacaggtctagggctgcatcttcctggaagattgggggactgacttcaccagccttgagccagggcactgacttcatggagagatccagggcctcgttctcacttcccatcttaatgaccgtgtggcggctgagctggaagtactccttaggctggaggatgtcaaagggcttcagttcatctttttccagaggggtctgggtgcctttaaaggggtgcaggccgaaggaagatggtggcttggggaaactggagctgaacttggattcagaactctgaggcaccgggatggggatgggaatagggactggcacaggcaaggggacgattacaggatacggcaccaagagggtggctggtgggaccaggggggacaagggggagctaaaaggctgtgggggcacagggkcatagccaggaggaggctgacagggtgggggcccgagagtgcccctgggagggaaacaaattctggagcacagcttcaaatggcaaagtgggctctgcggctggctggggatcctcaggtccaggagctggggctgggcctcggggtcctccgctccctggaagaggttgttgtggatggtactggagcggacgcgtgggcggacgcgtgggcggacgcgtgggcggacgcgtgggtcga

SEQ ID NO: 2526 - DNA, 1157 bp, Homo sapiens
ggcacgagctttgatattccttctttcttattcatttccatgtcactgcctgacttcaagcttttatgaagcttgaagttatatatcaaattgtaactgatctcctaattctcattttgtgtgtgcattccccaaatcattcttgacatatctgtgcaaatctcagcatgtcactttcccagtagtaggtatccatcagctccctgttaatctccatgaccagagattctgtccacctctccagcctcatcttgtgagcttctttccaatcacctcatcctttgcctccttagcttttgcctcggctggcctgataaacctctacctgcctgccaagtttcagttcaagccttagctctctgtcaagctcccgcagtccctcacccggactcacatgctccttgcacctgcagtgggtcagctgctttacatatattggactctttacttctcacgtagctttttaaggtgggtgggctttgtctccactttgcaggtgagaaaagtgaagctcagagagcttaagtaatttgctgacagtcacacagtaagaaaatcaagtggcaaactgaaatacaaagaacctgagctcactcctcaacatgttgctccttggctttagctttgcccacacctgcttttattttgttacgacgtttgtcacatttactgtgtttgcaattctccatttctgctacactcgttgaaagcatcagccccacctttcatctttatgtctccaaagacctgcacagtgtctggctcatgagaggtagttaagaaatatttattaaggtgatgaatgaaccaagcaatatacaaccaatatacatattcttttctttgtggtggtgtggagaagaaagggagaagtaataagttccactttctggagtggaagggttctagtgggacaatagaagattgtatgacctccagaaccatcttaagagtgattttaggattagctactaagggccaggcacaatggcacacacctatagtcccagctagttagaggctgaggcaggagcattgcttgaacccagaagttaaaggttgtagtacactgtgattgcatctatgaatagccactgcactccacctgggcaacatagcaagaacctgtctctcaaaaaaaaaaaaaaaaaaaaaaa

SEQ ID NO: 2527 - DNA, 1084 bp, Homo sapiens
ggtttcatcagtatgattatactcctaggtgaaaaaaaagatggagacaagggaaaaaatgaagttaacgaataaaacaaatgttatttcagatcacggccctgtgtgtgttactaaggaaagatataaggatttataacatatatttgttttccatttatttttatgaaggaattaaagaaattatcagaaaatactaaaagggaacaaagcattttaaaaacattccaacaatggcatgctgctttttatacagtatgcagtgaagttccttgcatttcaaaggcaagggtagctaaatctgcctcagccccttagcgttctgtactacccttatcttgccatttacaacatgaaagtataataatctatttacatgctggtatataccactatgagtttctgacaaacatggcacatcttggtggtagttcatttattctacaaatacttattcaatgtctactatgtgccaggcacacttttggacattttggatacatcaggtaagaatataaatacctctgccccatgaaccttacattctacctatattgcaaagttcctagcacatcgtagatttcttctcatggtcataagatgtctgcaccaattctaagcatcacatcttcatagaaaagcatccaaaacaggarggaaaaattagaagcaaaagggctttctccttttgggcctttcttttcataggaaagaaaatctttcccagaaccctcaaacatgtgatctggaccaaacactggctggcaaagagtggaatttcttaagtctgagcaacaagaagaaaaccgttaccataactaccaactcacctgcatctgtgccatgtgcttgcctgcccacctataactaaggatgagctgtttgtagtcttaggtcaactcctccacttgtgccttggatcctgccgcacgcccccatcacctacttgcggacattactccaacagttcttttctttctgtcctgtattatcaaatttctgttcttactggattttcatgctctttcatcattatgaaagcatgcagtaatttcttcattaaaaaaaaaaaaaaaaaactcga

SEQ ID NO: 2528 - DNA, 175 bp, Homo sapiens
aattatggttaccccctacacagatgtgaactcatggaggaactgaaatccttcctacaaagctacacagtgactgtgacaatggtgatgcacaccaggctactgttcagaatgagtttatggccagtaaactgtggtcaggaaacttactgcaaaaaaaaaaaaaaaaaaaaaa

SEQ ID NO: 2529 - DNA, 2845 bp, Homo sapiens
  misc_feature (727)..(727): n equals a,t,g, or c
gaattcggcacgagcctaaatgtattgattacttgtccccttcctcctttgtgacaactcagatgtattatatccacatactacttactcctctgaattcctccagggtagttatgcttttgcaagatgtggtaagtctatattgacaaagaaactcccagttatctatcaatttgttcctgaatgaatactgatgaggacattgttgatgatatcctaacgtatcttttgtatggggaagacctttgtctcagttgggammgcaatgaggcttctcctaatttggcaagcctttttatgccctaaactcaccaagtcttcccaatctttcctctttctagcttatcctatttctctttaactttctttatacgtatttttatttgtttttagtatgttgtgttttatgtagctttatgaactgtactttttcttctcctcctctttttttcttcatcttttaatagaggaatgtcaattaaaaaaaatctttttcaggggaagatagaaagagtaggatatattagtgtgtttgtttcctagagctgctataacgaagtactacaaaccgaatggcttagaacaacagaacttgattgtattccagttctaaaggctggaagtccaaaatcaaggtgttggtaaaaccatgctccctaaatatattggggaggatctgttccaggtctctcactttctgtcttcttcttctctttgcctctcatancttcaggtgttccttgacttgtaaatgtctgtcttcttccttcctttgtgtctcttcacatcatctttcctctccatctccctgttcagattttccttgtataaagamctcagtcatgttgaattagagcccaccctaatgacataattctatgattacctctgttaaaaccctatttgcaaataacgtstmttctgagacactgagggtttaggaattcaaaatatatkttttgaggggcagacatttcmacccacaacaagcagacacaatgaaaaaattaaagcaaactggattttaaaagatagagatgagatcttctaggcccttcaaagagaacttcagtgagacaactagttgaagacagtgtttaggctgtttttctatcatgcaaagaattccttctttgtatttatattttgctgctccatttctctttgacttttcctttcctttctttttcttctctcttctattttttaagagggaatataccctcttggtaaaaaattcaaaaggtctacaaatttaaatttacatattttacamagtaatgcaatatttattcattttataaatataaaaaaattaatatgtaatcattttagaaaagttttaaaaagcaccgttaaaaaagcacaacaaaaacaataaacttatgcaaaatttcaaacctaacagatcatctctgacaattttaggatttatatttttgttttatatatacaatatagttggatattttatacaattgatattatttcatatacccattttctagtccttttagcactaacaagcatactatgaatattttctcctgtcactaaatatccttcacagcatgagtttttgcagtgttctatgaaataaaataccataaaattttcaaagtcttttgtggtatatttagattgccttcaattttacagtaccatacaaataattctgtgatgaacatatttgtaagtaaatctttatttaactccttgactactttttaattttcttctagaaatgaaactgctatattaaagtgtaaatacattaaaatactctggataaatgtcaaataaattatagccaaacatccatcatggccactaaaaaagtctcaataaactatttattaaatgtctagttttatcacatgtgactttcctagtttgccatctgagacaacctaattaaaaattactcccttacgtattatagctacataagataattagctacaaaatacctatgtctacaaaaatgcttgttttacttcagaaaagtttagacaatatttttttcccacatagtaatctagtgcatgaaaataaaatgtccaaaaaatttatatcagagtttaaatgagtatggtggtttctaaaacagatgcaaatccttttaactttcctcccattgaaaagtgcagtctatctttcctttccttctccctggtagacttgtgaccaattccaccaataaaggatggtggaactgacactgcaacttctaaggtgacactatgcaaaggccacttggtttgcagcttccaccttgctttagtggaatacttggttgtcatgggggaagtgttccttgagccaccatgttggagaggggacctatagacacttggacctatagtcccagctgagctcagccttgcagccacatccactgaggtgtcaaatattaggttggtgaaaacataattgtggtttttgcatttttgaaatttgccatttgatattggaatacattcttaaacaaaagtggttatgttatacatcatgttaatgtacatttatgttttttgacactgaattattactgttaattttgtatttattttagactatagaaatagtgtgagacgaaaagcaaatttgagcgattttcttattcgaattcaaaatgggtcataaagtggcagagacaactcgtaacatcaacaatgcatttggcccaggaactrctaacgaacgtacagtacagtggcggttcaagaagtttcacaaaggagatgagagccttgaagataaggagcacggcagccggccattggaagttgataataatcagttgagaccactcatcgaagctaatctacttacaactactcga

SEQ ID NO: 2530 - DNA, 2576 bp, Homo sapiens
agctttcctgtaccttctctgcaggtagatgggacaaatgagtgtccggatcagcgggagtgggaaattgaaatactacaaagatctgtttaatcctgataccaactaatctccctttcaagggagagtctgggaagctgtacagctcatttatttttaaactttttctgtttacagagatctgttggtaatctgaggatttttattctacgtcgtcttgacagatggaaaacctgaagtaacttcgggctaaccttgtgtttttggaaaattagtagacttggtggtgaagaaactgggaggagtaggatattagctaactttgcatagccacatatagagcgtcgcagctgcattccaccaaagaggaaccaaaaggcctgtggtgttcccagggtacatattcatgccagaagtgaagtgcttggtgaattcgtttcctgaaagtttatcgcatacttgtactgggttaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagygaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacarcactatgtgcatttgctgtcacaataaagtatattttgtcttgcaaaaaaaaaaaaaaaaaactcgag

SEQ ID NO: 2531 - DNA, 466 bp, Homo sapiens
  misc_feature (449)..(449): n equals a,t,g, or c
  misc_feature (454)..(455): n equals a,t,g, or c
  misc_feature (461)..(461): n equals a,t,g, or c
tccccactgtgcctatggctcatctagcctgcttccctcatttttktgacctgcctggttcccatggggaactgagtttgcaatccggggagcaatactggctgaattcatgttcatattgagagcattctgagtagctggcagggccacacagaccttagcgggaagacagggacaccactttccaggatgatccctgtgaaaactgccatgtttgcactgccctcctctgtgagacatggcttagctcaagtccttgctctggtaactttccaacatgtgactttgggcacatgtgaccttcacctctctgggtttgtttcctcactsttacgctgcaggcaatgcacatacaatatttgctactttagggctatgagatgcactagttagttgtgtccaagtcattccttttaccaacagaaatgaagagaaagaggagaaaaaanaaaannaaaaantcgag

SEQ ID NO: 2532 - DNA, 1136 bp, Homo sapiens
ggcacgagcaggatagtcctcagcaagattccgtgtcattgtgttcacaagcacactagaattgtaacaagtctcagatttgggttaaggagagatgataactgtgtctgtaggatttgcccttcctctgtcttcacaccccattcactctgagacaaaggaggtacttccagggctgctggaccagcagggatgggacctcgcctctgccctgtcttggggtcagcctgcccagcgagtaccctctgctggctccttctggcatcttactgggtcctgccgtgcagggacaagcacacgggccctgaaaagctgggtcgacatgagcaggtagcagggccttcctggacctcctttgtttcagatcccaccatcattcagggcccaatttaaaggcttctcttccgtaaagtctcccatcactccaaccatggaatccctccctcctgtcactcttctttttttttctttaacaaatacagttttatttatttacttatttatttcacaaactcttatgtagctcttcctatctctgggcactgttttaagtgacaagtattaactcatttaaactgtcacaacaggccaggcactgacgcatgcctataatcccagcactttgggaggcagaggtggccagatcaccagaggtcaggacttcgagaccaccctggtcccaggagacctcaacttctccagagttctagcctcttcttaaagggccagagtcatgggaacccagatggggtgagggggtctcctgccacggcctccttacaatgatatgacttggcataaatttggatactacctccaaatacagatttatggtctggcgtgatagctcattcctgtaatcccaacgctttgggaggccgagggaggcagattacctgaggtcaggagttcgagagcagcctggcaacacggtgaaacactgtctctactaaaaatacaaaattagccggatgtggtggcaggtacctgtaatcccagctacacgggaggctgaagcaggagaattccttgaacctgggaggtggaggttgcagtgagttaagatcgcgccaaagcactccagcctgggcaacagagtgagactccacctcaaaaaaaaaaaaaaaaaactcgag

SEQ ID NO: 2533 - DNA, 1500 bp, Homo sapiens
  misc_feature (382)..(382): n equals a,t,g, or c
  misc_feature (388)..(388): n equals a,t,g, or c
gtattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattnctttgnccaggmgttyaaaacyagccttgtcaacatagtgagacccccatttctttaaaaaaaaaaaaagtctctgcttcttcatttcctcttttaatatcgttaccttgctttatattttctggatgttgatcactatctggaattataaatttattttttagttattatttgtctcctccctctagaatgtaagcttcatgagtscaaggacttggttttgktcttgctgtatccgtaaagcctagaccagtgcctgacatatggcaggcacttaataaatatttgaataccaaagttaatgttatagtagtgaaggagaaattatttcaaccaaaagtatttcagtaagccatgtatcccacattatgcaagaattgggagagaaatggaaaagtacagcttacagtctgtgttcttaatcagttgtcagaatgagtgccatagatagtatatgttgaagcaattgaaagaaaagaaaatatctgtgggcttgtgggagcttcatgaaaaagatagaaattgagcaagacatagaagtagaaattaagcaaggtactacttggatttagttgatgtacaagagaggaaaggtttctgtttacacttcatctttgactggtcatgtagtttaaagcttcatgagttaatataagtatcagaataggaagtggccaatttctgtgtgaaatatgaaaatcttgcttagaaaggtcttcttgtgatgtctatgtatgtataattcataaatacacagatcattccattgtgtgaagagaaagaaatagttatggaataacctaaattatgtcagattaaaattctaatgaaagccaggtgtgctggcttatgcctgtaatccttgcactttgggaggccagtgcaagcaaattgattgagcccaggagtcaaaaacgagcctcagcaaggtggaaaaaccctgtctctacaaaaaatacaaaacttagcagggaatggtggcatgcacctgtagtcgcagctacttggggaactgaggagggaggatcgcctgagcctgcagtgagcctagatcgcagtccagcctgattgacaaagtgagactttgtctccaaaaaaaaaaaaaaaaaaaactcgag

SEQ ID NO: 2534 - DNA, 2384 bp, Homo sapiens
gatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaatcaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaaaaaaaaaaaaaaaaaaaaaaaaaaaaaaa

SEQ ID NO: 2535 - DNA, 947 bp, Homo sapiens
ggaaaatacaaaaaaaaaaggaaaaaataaatagaaaatcttcaaagaggcaatctgtttaaatcttcaagaactggaaacagtaaaagtgaacaggtttttattgagcatgtcaataaaatgtttgcataagactttacaagtgctttatttcatgaggtttttattattgatcaaagcaacgaaaatgaacgggaaattcattctcatcaaatctacaacttgggaggaggtccgatgaaatccctggaagctcacattttttataaatgaagagttaattaccggtgggaacaatgagaacctctgtggttcttcctgatgcttggatcctcccagacctctgtttccagtctccttctccacaacctggcctatgcgatgcaagtggtctaactgatctccgcctagggaaggatccttcggcaacttgccgacaagagaagcagcgatgcccgaggcaggtccaaaggagcactgactgcgtgggattgattacactggaggaacaaaaggtcctgtggctacacaagtttgaaaagcagaaggtacaatcattgtatttctggcagacttttcaaagactttaatatatgaatccctcatatgaatctcctggaggattatataataggcagatctcccagccattttcactgaacagttcttagaattggtatccttgaaaaatttcacctaaccactcaatatggtagccactagtcctgggtggctattgagcacctgaaatttgcctagtctgaattaagacacattctaagaataaagcacactgtatttcaaaggcagtacaaaaataaaaaagaatgtaagctgtctcaataataatttttgtattgaatacgtgttgaaatgatgttatttttgatatattgagtgaaataaattgtattgctaaaatgaaaaaaaaaaaaaaaaaactcgag

SEQ ID NO: 2536 - DNA, 2187 bp, Homo sapiens
  misc_feature (49)..(49): n equals a,t,g, or c
taaaagataaaatccattcctcctcccagtgagcaagcatggcttcatnttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatggaattccagaaaccctcagggagccaggataattaggcaacccatctgaattggccacgtaatracaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatatttyctcaaaacacaaccagaaaacccacttccggtwyttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttacttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctaaaaaaaaaaaaaaaaaaaaaaactcgag

SEQ ID NO: 2537 - DNA, 937 bp, Homo sapiens
ggcacgagagagagtacagtagaagaaaagtaagatgggaaggcattggcctactcacctgctttccagtttgggctagaagcagtctcaggtatgagaaaagaacatgaaagggctacagaaaagaactgagaaggaacagtgtgcaggtgagaattcagttttgactctccacgtcagcacgagtttggccaatgatgaaatggcgtaatgagtgaaaatcccttactggcaaaatcaccagaaagtaaattctgtttttaggggtgctgttgtgctgcttagttccgtgtaatcaggctactctcttgggacagccattgtaaacactgccttcctgataaggatatagcaagttgtatagagtcaaagccaatttgtttaacagagccattcagaagaccctgtccatttttttgttcttttaatgaagaaagtaacgttttgaatgtagtgtttatgtatagtgactatattggaatataatgtgtaatgctttcaataaacccagaaacttttccaaaatattgtcttggttcataggatgtgatatggaaggatagacaccgtcttaatattttcccccaacagaatgtcaattcttagagtaggggtggggcaggaaagtgggctataaaatcactggctataaaatcaacttttcccctttgaatctcagaattcagtgtcttctagggcagatctctactcatcatctctacctgatatgaccgcacacgtgagtgcctggcacctgctctttctcttgctctgatgaccacttcctttctgcccatctgttttgacctcgcaccattctggagcttttaggaaaggcatttgtaacaaaggcaggacccaggtctcctggttttcatctccgtattgttttcactatattataaaaccttctttacttaaaaaaaaaaaaaaaaaa

SEQ ID NO: 2538 - DNA, 419 bp, Homo sapiens
aattcggcacgaggtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcacatccccctccggctgcgcacactgcatgcctgggaaaggccagcacttcatggaccctggggaggccccaccccctccccacacccctgctccccactgccgctgctgcctcaataaatctgctgatttgcaaaaaaaaaaaaaaaaaa

SEQ ID NO: 2539 - DNA, 4049 bp, Homo sapiens
cgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttccyatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgacyttgctgtatggaaaaataaagtgaaattgccctaataaaacttctctttcttaagtaaaaaaaaaaaaaaaaac

SEQ ID NO: 2540 - DNA, 1377 bp, Homo sapiens
  misc_feature (6)..(6): n equals a,t,g, or c
  misc_feature (19)..(19): n equals a,t,g, or c
tgcagnaattcggcacgancagtacttcattttttttatgtgactgaataatattccgctgtgtagatatatttcacattttgttcaccatttmtccgttgmtggacacttggtttgtttccaccttttggctattgttaacagtgctgctatgtacattcctgtctaagtctttgtttggaaacctgttttccaattctttgaaatatctaggaatggaattgctgagttttatgataattcaaagtttaccttctagaggaaccccagcaaccgtattgttttacattcttatcagcagtgtttgaggggtccagtttctccatgtcctcaccaacactgattttttattatttcctgattattattattattgccatactagtgggtgtgaaattgtatttagttgtggttttgaattccatttctttaatgactcatgatgttgagtatcttttcatgtgcttattggcgatttacatattttctttggagagatgtctgttcaagcccctttgcctatttttttaattgggtggtttgtctttttgttgttgagctgtaagaattctttatatatctggttactagaccctcatcagatatatgatttgtaaatattctattctgtagattgtcattttattttcttcatagtgtcctttgatacacaaacgttttaaattttgatgaagcccaatttatctctgttttcttttgktgcttgtgctckkgcwgkcatagckaarattttatcacsaaatccaaagtcatgaagatctcccccatattttcttctaagagttttatagktttcgcttgkacatttatattttatatcctctaaattttgkttataatttaaatcattgctatagacttggkccagtgagacctataaacagaggkcttaatttactcagtggttaaattgtcctaaaattgatttctgcaaaattcagaggggagatttttgggatttcatagagaaatctatatccatacagttaaatccttcatgatttcatacacttcacttttttaaagtattaaaacttttttatttgaagaatacgtggggagaagagaaatatatttcagcacttagatatgtagattatttccaaaatagtttaccactcaactagtcacttctgtgtaaatcagttttccctgaagcaagcattgtgttgttcccggctacaagcggtcctcattttgcatggtactgtgggaccataaaaatggccatgcaaagcaatcttaataatcaatggggaaaatgatgattgttccatgacctttaaaattctgctaaaatattaaaactcttaaggtcagttataaatgtagaaaaaaaaaaaaaaaaaactcgag

SEQ ID NO: 2541 - DNA, 862 bp, Homo sapiens
  misc_feature (862)..(862): n equals a,t,g, or c
attttaggagtgattttgtgaaatttatttttaatacagtcctagaattgaattgaaatatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgaatgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtgggaaagagraattagtgtgctatataaatccgggcmttccargtaacmgtaataccggggtatatgkgtttcctn

SEQ ID NO: 2542 - DNA, 1075 bp, Homo sapiens
ggcacgagcacaggtgacctaacttctctgagtctcactttcctatccatgaaatagaataatagtacttaccttgtagggttgttttaaagattaaatgagtcagtgaaggtaaagttgcttagcacagtgagtgcctggcacaaaataactaccaagccccaaatggtaactattattatccttcaaccttcctcatttccattaccactgagactcaactgctacaatgctgactacttatattcttcctgagcaccacatcccagctccacaggtataatcttcaagttaacacttttaaggaaacattactgggtataaaattatctctagtaagtcgtatgcgccttttctctgagctcactgtatcacactaaccagcagagggtgcacaataaagaagagaagcctctgactctgcgggaaggtctctcacagaaccaaggacgttgccacccttggctgggtgtacttgaccaaagcgagcctgactgaccctggtagtaggcaaagaatttggcctttacgtttgtatagttaattaccaggctaacaatgcagcaaggatagtaaagcattttacccctcccaaaacaaactgagtattctgacttcaggcttatgtccagctttttagctccgaaacccccccactcactgcacagctgtgttcctttcctggaatgcagttttctatcaggtagcactgagggtccgaacagttcacgtcaaaactatcaggaaagaagaatgaaaaggtaaattaagaaaaagcgggcttggctgggcggggtggctcacgcctgtaatcccagcactttgggaagccgaagcgggtggatcacctgaagttaggaatttgagaacagcctggccaacatggtgactccccgtctctacaaaaatacraaaattagccgggcatggtggcaggcgcctgttatctcagctactccaggaggctgaagtgggaaaatcscttgaacctgggaagcaraagttgttarataragccactgcactccagcctgggsgamagagcgagatccgtctcaaaaaaaaaaaaaaaaaa

SEQ ID NO: 2543 - DNA, 695 bp, Homo sapiens
ggcacgaggtcaggggtctgggctaaaatgcccgatgtttcagaggtcgctctgaaggtgacccaggtgggtggctcttcaccctattcttgtaccccgtttgacgatcacctaatcatcccgttgacccaaatcgatgccagtattttctgcagttttgtctttggtgagtgtgatccatgtcactgtgtggtgaggtttattcacagtcagtctggtctgtaaaatagaacctgcagacagtgaacctgaaaagcatactaggatcatccaggcctccctccccagccttggagctgggaccctcaaagcagggacatagaaggacttggagtgagccacccaccaactccagggtgaaggagagtgtgagttcagaaaagcccccttttggctggttgtggtggctcatgcctggaaacccagcactttgggaagccaaggcaagcagatcacttgaggtcaggacttcgagaccagcctggccaacatggtgaagccctgtctctactaaaaatacaaaacttagctgggcatggtggcacatgcctgtggtcccagttactcgggaggctgaggtgggagaatcttttggaccccggaggcggagattgcagtgagccgagatcgtgccactgtactctagcctgggcgacagagcaagactccatctcaaaaaaaaaaaaaaaaaaaaa

SEQ ID NO: 2544 - DNA, 721 bp, Homo sapiens
ggcacgagcagcgtgggcgttatggccatcatgaaaatgtcacagtgctacagagattttgtttatggccagttttggggccagtttatggccagattttggggggcctgttcccaacaccaggagatgtgttgatttgctccagcaatgaaaccacatctggtacggcagctgcaattggagtcactacttagttaagctcatcataatccactgtcatcctccaagatccatctgtcttctgcacaggccaaatgggagagttgaacagggagatggtgggaatcaccacccctgtgtccttcaagtccttgatagtagcactaatctccatgttccctccagggattcaatattgtttttgatttactacttttctaggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgtaagttggacctgagctaaaactccattaattacctgacctcaggtgatccacccaccttggcctacctgtagggaccagccccacagggtcggtgggtttttctccccgtgtgcggagatgagagagcatagaaataaagacacaagacaaaaaaaaaaaaaaaaaa

SEQ ID NO: 2545 - DNA, 1029 bp, Homo sapiens
ccaggttggccaggctgtcccctgatctttaccttagtaagtaacagatttcttcatggatttatcaatttgtagacatcatctgctgatttcttgtcacggctgttgagatcttctccctcccatccacccactgcaccttcaccttccatatcctgaatgagtttatgtcatgagcatagttggtcattggttgtgttttctaaataagatgcaaaatattgttggctgctaaaacaagtaatatgttcagctaggcttttcttgtaccattctatcttcccttaaagctaattaactttgtttttaccattagcctgattttcttttacctgctgtttgttttttccccacaaagctcccacctctcacacacctatcagttgtattttgcataggtttaaataaattgatctcccctcaccacttccctccaagacccccttatcctcctcctccaaatgggactggttgtgctctgacctggaagtggagctgtkgtcccaaacctycctgtccttgctcccctgtgctgacctctgtttccagtgtggtcatctctttcccttcatgctgyccgagcaaaacttctgggagcttttgaagaaacagatgatttttttcgggggktgggggaagtccttgattgtctgaaaacgagtttatttaccctcatagttagaagtttggtggggtataaaaatctagattgaaaatctgtatttgtaggccgggcgtggtgctcacgcctgtaatcccagcactttgggaggctgaggcgggcggatgacctgagtttgggagtttgagaccagcctcgccaacctggcgaaatcccatctccactaaaaatataaaaatttgccaggcgttttggcatgtgcctgtaatctcagctactcgggaggctaaggcaggagaatggcttgaacctgggaggtggaggttgcagtgagccaagatcgagctactgcctgggcgacagagcgagaatccgtctcaaaaaaaaaaaaaaaaaaaaaactccga

SEQ ID NO: 2546 - DNA, 560 bp, Homo sapiens
ggcacgaggggttttaagccatggttagtgatagcatgtcatttgaagatgtacccccttaatgacttacaggctcatagtgattttttcttttttgttgttgttatttagattagatttgggtaagtctccgggttggttggaaggactcaggtttatgtggagttttgtcttttagttaatgtgccagtaacagagtttgcccgtttgtgctatgggatactcatgaggtgcccccaaacccagctggctacatatacagcctcttgcttcctcttcactgtctcctgggctcttcctccagctctcctcatgccaaactcgtgactgcatggacacaacatagggaggtgattaggaccatgtattttggaggcaaactgtctgtatttgagtcctgcctaccctggttattagtgaagtggtttgagtaagttacttcaaacttctgtgcacttcagtttcttgatctggaaactgaaggtaatatacctaccttacagggatattgtgaggattaaaatagataatgtaaaatgaaaaaaaaaaaaaaaaaaaaa

SEQ ID NO: 2547 - DNA, 1288 bp, Homo sapiens
ggcacgagcagaaaccagttctttcaaaacattttacctctgatgtcacccagcttcctgaggctgctccccctttttgcagtttcagcacaacaactgaccagcattccttcctgataagagaccaccaaccagagtagttctgaccagtctacagaggatgagtagtgtggattttcatgtcctctcttcaccttttgacatcagagggctgaaaactccacccttggatcatgctaacactgccattttttgtgcctgggttccatagagagtcacgaagctctgtgcatgtgcttgtttctcctttcataaatactcatgactcctcctctagcttatttttatttttatttttgagacggagtcttgctctgacgcccaggctggagcgcagtggagcaatcttggctcgctgcaaactccgtctcctgggttcgagtgattcttctgcctcagcctcccaagtagctgggattatgggtgcccaccaccatgcctggctaatttttgtgattttggtggagatggggtttcaccatgttggccaggtggtcatctcaaactcctgacctcaggtgatccacccgccttggcctcccaaagtgttgggattagaggcgtgagccactgcatccgggcctcctctacttattgaatatgtatatttggccaccctgttcatcataaattcttgttccccttgcccttcccatgaagtgtgtttctggcttctggctgggggatacactttcccagactgttagaaaggccaccctgcaggctgcaagcctttatatgtataaaaaaagctctctttttcaaatttatgaaactcatgattcttcagttgacagactggatgagaaggaactctccaggtaaggcatatgggattttgaagcttccagatccaggggaaggaacatgccttgaagctagaaaaaccttgctttgtttaagatatagaaagtagggctggaacagagtgaaggagggaaagactttctaggacaaagttagagaggtaagctgaagccaaataatccaggtcagtgtcaatccttgatgatgggataaatacagaaattgaaaataagcttgtaaagccttttaaatgatttgacatagtggtttgatagctcttcaatctaatgaaaaaattggacttatattttgatgtcttatttctggtttcattttttctagtaattcatttttattttatcttataaaagtatccatcagagaggaattgaaaattgaaaagaaaaaaaaaaaaaaaaaa

SEQ ID NO: 2548 - DNA, 1492 bp, Homo sapiens
ggcacgagtataattcttttaatgtgcattttaattccatttgctagtgttctgttgaggatttttgcatcagggatattggtctgtagttttcttgtgtctttgtctggctttggtgtcagagaaatgcaggcctcctagaatgtgtttgaaaagtgttccctctgtttcagttctttggaagatagctgtttgaggaagattgatgttaattctttaagtgttcagcagaattttccagtgaagttctctggtcctgggtttttctttgctgagaggtttttgattactgctttaatccccttagttattataagtgtgttcaaagtttttatttctccatgattcacccatggaaaattgtttttagaggtttatccatttcttgtagattatccaatttgttggcacataattgttcctagtagtctcttgtaattcttctatttctgtgatatcagttgttatgttccctctttcatttctacttttagttatttgaacttctttttttcttagctaatctagctaagggtttattaattttattgatcttttcaaaaaccaactctaggtttctttgggtttttttctgcttttttttttctatttatttatttttttctatttatttatctgatctaatctttatttttttttctcccttctgctaattttgggtttagtttgtttctttttttcaatttccttgaggttgaagttaggttgctgattttgagatctttcttcttttttttaatgtaaatgtttactggtataaacttccctctttgtatggcttttgctatatatcatacattttggtatatatttttttttgttttcgtttgtttctggatttttttctaaatcccttgtgatttcttctttgacccattggttgtttaggggcgagttgtttaatttccacacatttgtgtattttctgggtttacttttctgctattgacttctagtttcattttgttgtagtcagagaagatacattgcatagttttagtcttcttaaatttgttggtgggcggcactggctcacacctgtaatcccaacactttgggaggctgaggtgggcaggtcacttgagttcaggagttcaagagttcaagaccagtctgggcaacatgacgaaatcctgtctctaataaaaatacaaaaaattcactgggcatggtggtgcataccagtagtcccacctactcgggagtctgaggtgggagtatcagttgagcccaggagattgaggctacagtgagccttgtgctctccagcctgggtgacagagtgaaaacctgtcttaaaaaaaattgttggctgggcacggtggcccacgcctgtaatcccagcactttgggaggctgaggtgggcagatcacaaggtcaggagatcgagaccatcctggctaacacggtgaaactccgtctctactaaaaatacaaaaaaaaaaaaaaaaaaaaaaaaaaaaaaaaaaa

SEQ ID NO: 2549 - DNA, 899 bp, Homo sapiens
ggcacgagagatttcttacttgttgatcacttattctggtacctttccccaaatgatattactgatttaattaggagatacaggttagagggtgctctttggccaattgtgaatacagtaattgatcaaaaaaaaaaggaggatggaagtacgtacacacatattaacatgataattatagctaaagtggtactcttttttaatagcagtgcatcctagagagtaaaatatgatggttctcaagaaacattctgctggggaaaacagtgtttgaatcttagtattttatggaactgcttttttgcttttataaaagcaatttttgtattgacttttggaagaaaatcagttccaataaagcacacattttcatttgtatatctgtcagaagctgatagatttactatactattctgttttggaataataaaaattgcaggcataattaaataaccaaatagttatccccaatgagagagttgctgtatagtttaagagacagatgttcagatctgtctttaattaatctctgagtaataaggagtaataaatttggtcatttaatattttttccttttaaaatgttttatattagggaaaatgctcacaatagtgttttcaggttttatagaattagttgtctttaataaccaatcataggctgagcatggtggttcatgcctgtaatcacagcactttgggaggctgaagtgggaggattacttgagctcaggagttggggactagcctgggcagcatagtgaaaccttatctccacgaaaaatcaaaaaattagccgggtatggtaatgcacacctgtagtcccaaagcactaggattataggtatgagctgttatgcctggccaagatctctttttacaaaaaaaaaaaaaaaaaa

SEQ ID NO: 2550 - DNA, 2006 bp, Homo sapiens
ggcacgagctttgttcatacctctacagaaaacctgctaacagttgaattgtttgtacctcttcccactgccccacctccagctttccccagactgaatgtacttacgtatcaaatacgtttctaagttgcctggattacttctgtawttcttttttgttctcttcctgcgattgtggtattcatgggaaatgcaaataggttgatttgttttgttttagcagtttttctcctttcccattctcactgatgtttaattttattctttgaatatgtagaatattatgtattttgtatagtaaaaactattaaaaaggctatatactcggagtctctctctttctcccatcccttctgctccattctccacactcctcccttgtaggtgatgaacctcattgttctctggtttatcgttgctataaagagaaacacatacgtgcttgttttcctgttttctttcctacacgaaacgtagcatgtatattactctttttcactttgaccttttgactttaggatatacagattgctccatatcaattcagaagcgctcctcgtcctttttcagtactccgttgtgtatatgctccagtttatttaaccagtcttctgtgcttggagatttatgtaggtttccagattttgcagttacaattaatgctataatgagtcactctgtgcatgtatgttttttatattgttggaggtgtatcttcattataaattcctaaagtaggacttctgggtaaatgcatatgtagttttgatagatattggcaaattccccttaaaaggggctgtgccagtttgcattcccagcagtgtatgagagtgcctgtttcctccacagccttatcaacagtgtattgtcaagctttgaacatttgctaatatgacaggttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatccctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaarggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctaaaaaaaaaaaaaaaaaactcgag

SEQ ID NO: 2551 - DNA, 1242 bp, Homo sapiens
ggcacgagatttcttagaactgcatgtgaatctacaactagctcaaaataaaaagtttaattataaaataaaagctacatgaaatgaagcaaaaaataattcacccttgtcacgcacacagagtcagagactgtaacataatttgcaggatctagagcagaatacaaatgtaaaacatcttgttaaaaaattattaataattttgagacattgataaagcattaagccgcctgtggggccctttaagcatgataaactgtgctaccacacagattgcacattcacgtatctggccctgcaaatggaatgatttttgcccatgatcaattcaccatggcctctttgggctcagtgaatttgcttcttcaggagggtaattttctcttctttctctgctaagctgtttaacagtagttgccctgcctaatgggcttcatccatccatttctctcagattattttcatgatgcactaggatgaagcacaccctttctcctagtcttgaggaaacgtcgatattcagaatatttaaacgcaggcactgaccaatcagaagagtttctggccaacgttccacacttgagggaaatgacattatctgagccctgaagaaaaacgttgtagatattctccagatcaaagcatcgacaggaagattttagatgttgaagttcgtaatatttcctaaagcaggtatgaattactagtaacttaataggtatattaactgatgaagttttcatttctcagaacaaaccagtcaaggaaggtgctattatactccttttattcatatagatcttgaggctgagacagtttaatcaatatgctataattattgtgtaataataaattaccataaactaggggtgctatgatctcaatatttgtatctcccactcccaaattcacatgttgaaatcctgactcccaaggtgatggcattaggagatgaaacctttgtgaggtcattaagtcatgagggtagaataccgatgaatgggattagtgcccttacaaaaggggcccaccaaagctgccttgttccttctactatgtgaggacacatctagaagttaccatcaatgaaccagaaagtgggccctcaccaggcaccaaatctgccagcactctgatcttggacttccagcctcctgaactgtgagaaataaatttctgttgtttataagttacccattttatggtattttgttacaggcacatgaactaaaaaaaaaaaaa

SEQ ID NO: 2552 - DNA, 1467 bp, Homo sapiens
ggcacgagcttgatgtaaatggactttggttaataagaatatgcaagtattggctcattaagtataataaatgtgcaaaggaaatggaagggagggtatatgggtactctgctgtctactcagttcattaaacctcaaattactttaaaatatagtctattaatttaaaaaattaatcatgttaacttacactatcatgttttctttgattgttgaggtcatttctgggggtctgtcttttatttagtgacagcatgttgacttgcccctcgctcccacttgtttctgacataatttcataccaagcatatatccacagtagacctcctttctttcatggaaatgcacagcttatataaatatattgtagaaaattgctgcttttacttagactaaaagacacaagagtcccctgtaacaaacagcttgaagttattcattcactgaggtttgtacagggttcctgaaactgtcctgtttcaggagctgccagataacctgatcctagagtgaaactcactttggcattcagattttgtctatgttgatatacctcaacagtttaagatcttttttaacttacatggctccatgaaagaggatgtgatgtttcagtgttcagtttggtactattaattatcccttgtagccttccactagaagtgatactttcagattgaacattgtttcttaagttttttcctttccacccctctctcttcttcttcagaaataaagctctgcatgtgtgttggtgtgttttaagtataatttttaatctgtttgtggaaccacagaaatggatccaagaggtaggtaaggtcttaaattgaatttgatgttaaataagctggcctttgacccataggcaatgagtgaggagcaccgttgggtgtaagactagaagcagaaatactaggcattttagaggccaggtgaagggtgaataaggacatttaggtcaattgaaataaaaagaaaaagacagatgtgaaatgtagaagacttaattatggtaggaacttagtgatttggagcctggcagcctgagcaggaaggtgaaaacattgacagtaggcaagtttagaggaagagctagttttagatgaaagattggaatttgtacaagttgaattttagatgaagtgtagtggttaaaattcaggactctgggccgggtgtggtggctcacgcctgtatccccagcgctttgggaggccgaggtgggcagctctcttgaggtcaggagtttgagagcagcctggccaacatggtgaaacctcgtctttactaaaaatacaaaaattagctggacgtggtggcgtgcacctgtaattccagctacccgggaggctgaggtacgagatcagttgaacctgggaagcggaggttgcagtgaaccaagattgcgcctgggcaactgagcgagactccccatctcaaaaaaaaaaaaaaaaaaaaaaaaaa

SEQ ID NO: 2553 - DNA, 851 bp, Homo sapiens
gcatgaacacaaaggagcttttaagagatgtccataccctccttttataataatacaaataaatgcaaaagtcaaagcaaccccgcatattatgtttgattctcctggtaatacccacactacttcagcagtattcttgtacctgccacattaagtaatttaaacctgctatttcactgagcaagatagataaaacatgtcatctccttgagattagtttttgaaaatatgtattacctcacagcagcctaacgcatcttgccgtattgccctgctttcatcttgtcaacagaattccactgggtggaatttgccatgtttgttttaaagttgtttatgcctaaacaacttgaaaaaattttaaaaaggtacattttcctcccattttctgaaagtgtagcaaatatgcaggtaataagtatccttataaatgtccagattatgtataccaagtggaattcttatatgggtgttttgcaatgtgatatttgtaatattaacatgagtataagattactgatttaaatctgatattaaaattaattgtggctgggcatggtagctcacgcctgtaatctcagcactttgggaggccaaggtgggtggaccacctgaggtcaggagttcgaaaccagcctggccaacaaggtgaaaccccatctctactaaaaatacaaaaattagctggacatagtgatgagcgcctctaatcccagctactcaggaggctgaggcaggagaatcgcttgaacccgggaggcagaggttgcagtgagccaagatcaggccactgcactgtagcctgggagacagagactccatctcaaaaaaaaaaaaaaaaaaaactcgag

SEQ ID NO: 2554 - DNA, 1266 bp, Homo sapiens
  misc_feature (497)..(497): n equals a,t,g, or c
  misc_feature (578)..(578): n equals a,t,g, or c
  misc_feature (606)..(606): n equals a,t,g, or c
  misc_feature (615)..(615): n equals a,t,g, or c
ggccacgtagggtcaaaaccacggttccagcaggaaataagcactgggagaggacaggacacgtacccccttccgccgacaccccccacccgatggcaggagggagcccaaaccttgcagcttccatggctcatggctcatgacaatatcattcttaaaattctttgagtttatcaatacgttttgcccttacctgccctacaactgtaaataacaaaatgtatgcatttcctactttttatttgttccgaatgtattctcaagcttcaagaacggttcccatcctaccagacttccaccgtatcaggattaaaaaacaaaacaaaactctgktattctctccatagcttatggcttttaaaaaataataatttgaacaaacaattcctacgtggcatagatctttccatcctggagaatgttactatttcagtctgtcatcttttgtagatattaaaaacctttcgtatgkcaatttctttgctcctcaccaccancttttaggcaggtactagtattagctcgatgcatttgacacgtgtttaatgttattcaatgccagacactgaaataggccntagggatgtataacatattctgtttggnaaattgagnctcaaggaggctaaataccctgccccaggttatatagtctgggattcagtctgagacaggcccccaggtttgttggactccaaagcttgtgctcttaatcactatacttacggttgcctggtagggttgtttgggttgtgcaatgtggcactgagcagctgcactgggtaatcctgccattttgtagccgtccctgctgttttgtctcttctaagtggggagagaacataatttcgtacaagagaaagatgggatctttctcttctttcctattgggactcagcatcttggtggccttacactgtgtgctgaatgagtctatactgttactatctatagtaactcccgggcccttcctgtgcaagaatttagagccccaagctcccctatacatccccacaacttgcttgctcagatatcactttttacctgcttatgaagcctcaaaaatttttatctcagctcacggtaagaaatacattttacatcatgtctcaatacacacacgtatgtctttacacacatcttaagtatatttaagcatacggcagccaaagcttggttgggctatagcaataagtgaccgctaccctctctcctatactcctgagtaaccattgctctcttaaaaaaaaaaaaaaaaaactcgag

SEQ ID NO: 2555 - DNA, 1623 bp, Homo sapiens
  misc_feature (1333)..(1333): n equals a,t,g, or c
gaattcggcacgagcagagattgggattgtttgattgggtctttagcagtggtactaatagcaacttctgtctctagaacattggaaaattaaaatgtgtttatctaccgtttttttcctcgaggttatatgaaggtagaaatgaatcagactagatgattagctaagcgagactattaaccctcatcccttcccctctagacaactatgaaattagtcattatgtatkcsatccttctwgcagtctcttctctgacagttataaaagtgatttaggctgcataatgttgtttgaatgaaatgaaaatatagactagagctgtttttttttttatttccatcagtctcttcagtgaaaactaacatttgagcatgattctttttttaaatcattttgtgacagtttagcaagggttgtgataagcaagttatggtatggtaatatttctagtgtccacgtttcytcacatgtctggtgtatgggaactactaactccatcrggaccttgcctatagtaggtacycmacatttactgaattaaatcaataaacatttttaatgaattacagtacaagtcagacctctgtatctgtgggctctgcatctgcaaattcagccaaccatggatcagaaatattagaaaaatggaagaacagtccagcaatacaagtaatatgaataaaaacaatacaacaactatgtacattgtatcaggtattataagtaatttagagatgctttaagtatactgaaggatttgcgtaggttatatgcagatactgtaccattttatataaggaacttgagcatctgtggattttggtatttgcatggttcctggaaccaatcccccagggatactgagggactatagttgatcataccacctgattttagagattttctgagtctcagaagttaattaagtaaactacaatagtctgttcttaacctcggaggatacattccaagaacctcagtgaatatctgaaaccacagatagtattgaatccaatatatacacggtaatattttttcctatacatatgtatctataaagtttaaattctaaatcagacacagtattaacgataataataaattartgcaagactgggcatagtggttcacacctataatcttaacactttaactatgacgttgtctytgaaaagaaatcagctagcccaaggtggctcatggctgtaatcctagtgttttgagaagctaagtcaggaagattgcttgagcccaggagtctgagaccaccctaggcaacatggtgaaaccctgtttctataaaaaataccaaaaaataggctgggcgcggtngctcacgcctgtaatctcagcactttgggaggctgaggcgggtggatcacgaggtcaggagattgagaccgtcctggctaacacggtgaaaccccgtctctactaaaaatacaaaaaattagccgggagtagtgggcgcctgtagtcccagctactcaggagactgaggcaggagaatggcgtgaacccgggaggtggagcttgcagtgaaccgagatcgcgccactgcatgccagcctgggcaacagagcgagactccatctcaaaaaaaaaaaaaaaaaaaactcgaa

SEQ ID NO: 2556 - DNA, 1441 bp, Homo sapiens
  misc_feature (357)..(357): n equals a,t,g, or c
cacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcanaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaaactcgag

SEQ ID NO: 2557 - DNA, 576 bp, Homo sapiens
gattcggcagggcacacatgtgcatgcacacttccagcctcctcttcctgctggtgcttctcagtgatacctatgagaaggatcactttccttccttatttccttttgtgggataggatggatctaaaagggacacattaataagaaggcatagtgattaatgtattcagcaaaggttttttccagtcttctcttattaagaaacagactttttcccttgaaatgagatttcattggccttctttatgtaagcttattgtgccagcaattgtgcttgttgcagtaaaagaagattccctcttttgtgggggtgctaaaaatcccacctacatacatccacacaattctaccttagatacccagttcatagtgtgaacaccactgtcctaagtggagatttagtttaaaaaaaatctttctggctgggcacagtggctcatgcccataatcccaacactttgggaggctgaagtgggcagaattgcattagcccaggagtttgagatcagcctgggcaacacggcaaaaccccttctctacgcccccccccacaaaaaaaaaaaaaaaaaactcgag

SEQ ID NO: 2558 - DNA, 5048 bp, Homo sapiens
  misc_feature (2497)..(2497): n equals a,t,g, or c
  misc_feature (5010)..(5010): n equals a,t,g, or c
  misc_feature (5035)..(5035): n equals a,t,g, or c
gactagttctagatcgcgagcggccscccttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcrgcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgyganctgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccaaaaaaaaaaaaaaaaaaaaaaaaaaaaagggcggccgctctagaggatccaagcttacgtgacgcgtgncatgcgacgtcatgagctcttgctnataagtgtgcacc

SEQ ID NO: 2559 - DNA, 1134 bp, Homo sapiens
  misc_feature (151)..(152): n equals a,t,g, or c
  misc_feature (441)..(441): n equals a,t,g, or c
  misc_feature (503)..(503): n equals a,t,g, or c
gctcgtgccgaattcggcacgagatgcagccctgtgtcatcagttgggaacagtgctcttttgtgtccccacgggggcctcatgtttacatttgcttccatgaccaaagaagattctaaactgtgagttaattctcttcatgtgatttttnnttcttcttttctctttttgatgattaataaaatatgtttaggaaatttctcatctgacatagtctgttttaagaatttagtcctttgctgaattgtggggtttttttttccccttttaaaagagaagaagactgcttctccaggaaagacaagaggctgcccgaggctatttgtctttttgctctttccttgtccctcttgaagacaacacagccaccctttctcttcccccgctgctggtgaccagtgctgagacctcttttccagaatcacagaatcaacatggtcntggktataggtttgttctgccatggccaggcttcagacaattaarggaggaggctagcaggntggcagagcaaagccactgcactggtcatctggaattctagggtcttagacccaaattttattccatgcttcargtacttccagaggtgtycatctgtgaattycycccgattttaccaaaaatcgtgatatacgagaaggtagaatgcttccaacattgtcagaaaatcaggaaaaggaaattggaacacataaataaaaatgcccttggggttaagctagagttttattattcatatttcagtactttaacatcatttaagggagttcaaagtttatatattctctacattttctccctcctctttctctccctccctctctgcatcccgccttccctgttgctctctcactctcgctgtgcatctctcttctctttcctccctccctttcttcctgtcgttgttattgcaaatgtcagacttccaggaaaatacaccagtaagcaaatgtgtgttaccattcagtttaaaagttaaatggttcaaatatgattaaaggccccacagtgcttatccttctgttgctacttctctttctcccacccttcctctcacactaaccactgtactgaatttagagtttatctgtctcagaaagtattctgtaaaaaaaaaaaaaaaaactcgag

SEQ ID NO: 2560 - DNA, 1586 bp, Homo sapiens
  misc_feature (24)..(24): n equals a,t,g, or c
  misc_feature (70)..(70): n equals a,t,g, or c
  misc_feature (271)..(271): n equals a,t,g, or c
  misc_feature (283)..(283): n equals a,t,g, or c
  misc_feature (1525)..(1525): n equals a,t,g, or c
ggcacgagaatgaaccttaatttnctttttttttgagtcagagtctcgctctgtcgcccagactggagtncagtggtgcgatctcaatttactgcaacctccgcctcccgggttcgggtgattctcctgcctcagcctcccaagtagctgggattacggatgtgcaccaccaggcttggctaatttttgtatttttggtggagacagggttttcccatgttggtcaggccggtctggaactcctgacctcaggtgaatccactcacctcancctcccaaagtnctgggattacaggtgtgaactcaccacgcccagcctgaagcttaattttcaaagacccaatctgagggtctgggagggaccctagcaatgtgttcacttggttaatttttaaaaaagttttattggtatataatatatgaatgagaaawttcataaatattataagtgtgtagtttaagatttttcacaaactgaacacacatatataactagcatccagatcaagaaacagaacattgccagtatgtggtcacatatctttgaagaatttgcaaatgtaagttatctaaaccacagtcagctaaaattgccgtctttttacctgacttcccctttgttacactcttccttatgttgggtggcattggaatggctgtgggcacttttggggtctggctatggggaaattgacttggagagatatttagttggattttagcaggatatgtttacatggttcatagcctctttgtgtatagtcaaggtattactagccatcccagtatgggaatggtttctaggaatactctatgtctgttgtgctaactcatggggcattgtgacataaacgtgcatagctagaggttgtctagcaatatgaatgtgtcctatggcatctggcacccaaagtgtgtggttagtagaggaaaaacaaggtttgatgtcaaaagccagtctggggaaaattctttaagattttgtagctttaatgaaagagacttgttaagaattttcccaggtttgaccatagtcctaaaagttgatataacattatttattgatgatgttcctgtgctaaaagaaaacttttctaagccawcaataacaacaggctgagcgtggtkgcttacgcctgtaatcccagcactttgggaggctgaggcaggcagatcacttgaggtcaggagtttgagaccagcctgccaacatgacgaaacactgtctctaataaaaatacaaaaattggkcaggcgcagtggctcatgcctgtaatcccagcactttgagaaactgaggtgagtggatcacttgaggtcaggagttcaagaccagcctggccaccatggtgaaaccccatctctattagaaatacaaaaattagtcgggcttggtggcacatgcctgtaatcctagctacttgggaggctgaggtaggagaatcacttgaacccaggaggtggaggttgcagtgagccgccaagatcgtgccactgcactccagcctgggcaacagagtgagantctgtcaaaaaaaaaaaaaaaaaaaagaaaaaaaaaaaaaaaaaaactcgagggggggccc

SEQ ID NO: 2561 - DNA, 1703 bp, Homo sapiens
gatttaatagctctttgaacctaattcagttcttttcatggtcttacctcaatgcaggtccaagacaaagtttctaggcctgttccttgctatttgccccagtgtagctctccagacaaaatggccttctttcacttactgaaaggcactgggttatttcctccctcgctgtcttcatctgtgctatgctttgtggstgatctttttgmctggactattcaccgttctgctcttctcttcctcttgcccctctccgtcttttcctgctaattccagattacctttaagatcttagtttggatgtcattgtcctagggacacccatcttgacacctatattatatwaggttaatttttccagaatgtgctttcataagacaatctatacttctcagcatttaacataattgtaatgaattaattwctygtgtaattattctttaatgcctgtcttcttcactagattgtaagccttctgaaggcagagaccacatctgtcttctattgctctggcttctaggacagtgcctggaaagtagttgtttagccataagtatttattgaatgaatacaagggctgtgctgtgctaggttctcattcattcagcagacatctgtgragcacctgctctgtgccagccccttggcatgagaggaaggtgggacataccaagattaacaaatcgaggaaatcgcatctgctagaggagcaggaacatagactcctgtaactgtagcccatggcaggaagtggagagtaaatatggagatgaagttagaaaggcaagtaggtggtttttgatgctgctttcttgttcaataaattgagtacctgctgtgtgccggggctgggcattcagtagtgaagacgagagaattcctaccttcaggaagattatagtctagcagggaaaagaagcaaagaaaccttttcctcctaggccaacaggtatttatggagagagtaggtgagcactttgaggtggtccttttggtctaagaatctgtattgagacttcacacttcattagacctgggcgaggcagttataaatactctcattaaccagagtgaaattccaagggaaaaggaagggaggataaggaacattgtttcctctcattgcatctgtggttaattcaggctctgaaatccttcccatgggtcatggacctatggtttcctatcctaagttggaatatgtgcagttaaatacctaaccattctcagtgtgccattgtctcatttgattcccacatagccctctgaggtgcacaggcaggaatgcctatttttcagctgggcaaacaggctctggaaggcagacttgcccaaggtgacacagtttgaactgggaagggatcagaaatctctctggctggctgggtgcggtggctcatgcctgtaatcccagcactttgggaggccgaggtgggcggatcacgaggtcaggagtttgagaccagcctgaccaacatggtaaaaccccacctctactaaaaatacaaaaaaaaattagccgggcatggtggtgcacgcctgtaatcccagctactcaggaggctgaggcaggagaatcacttgaccccgggaggcagaggttgcagtgagccgaggccgagatagtcccattgtactccagcctgggcaacagagcgagactctgtctcaaaaaaaaaaaaaaaaaaaaaaaaaaactcgag

SEQ ID NO: 2562 - DNA, 1114 bp, Homo sapiens
ggcacgaggggattataggcatgagccaccgtgcctggcctattctgtagtcttttgtatattacttaggattttctacaaatgcttatgtcatcagataataaagatagttttacttttctcttgcctgttcttatttcttttatttgtttttcttacctcactgtactgggaagtaacaccagtataatagtgaataaaaatggtatgagcaggtgcacatggctttttcttgatcttggaagggacttttttatactaacattaattttttaaaaaaaaattagtcttatttttcaacctgacttaagtcatttaataattactaggaaccaagattttgttgttatttgtcagcatagtaatccttttaagattatattttaaatttttttagaatgaagaaaatgtgcctttttatatgttatttggacttttgataaggaggaatcgaagaattgcatttgagaatattctcagagttcaattataaatctttttagaagaaatttaaagaaaatattaatagtaattctatcagatattcatcaatacatataatttgatttggtttaattaggtaaggtataggatgcaagaacaacaaaatagaattgataggtgtaattatagaaagatactggtagctgtgtgttgttttttctcttagacacagacacagaatttaacacctggaaagcagcatggaactgttagcagtttatatatatataatagtggtcattaaagaagaaaataaatgtttgtatgtattttgtttataattttagaagtacagttcttttaagcctgcacaataagctttttaagaaaggtatatataagtttaacttggccggcacggtggtggcaggcagatcacttgaggtcaggagttcgagaccagcttaaccaacatgctgaaaccctgtctctactgaaaatataaaaattagctaggtgtggtggcacgctgtaattccagctactctggaggctgaggcagaattgcttgagcctgggaggcagaggttgcagtgagctgagatcactccaccctactgcagcctgggtgacagagcgagactctgtctcaaaaaaaaaaaaaaaaaaa

SEQ ID NO: 2563 - DNA, 624 bp, Homo sapiens
gaattcggcacgagacagattcattttgcctgatgtcaaattccataggaatggaatctcatagtatctatcatttgcgtttggcttcttatattcaacatagtgtttttgaggttttttttttaatgtgcttgtaccagtttattttccttttttattggttagtagtattttatttggaatgtaccacagtttatccattcacctcttgatggacatttgagttgtttgtcatttttggcaaaacaagtatttatctcaagaagaatgtgactggagtgagacctagccattggtgggtaaaaaactagcaccaaaggcggggcgcggtggctcgagcctgtggtcccagcactttgggaggcaaggcgggcggatcacgagaccaggagatcgaggccatcctggctaacacggtggagccccatctctactgaaaatacagaaagttggccagggcgccttggcgggcgcctgtagtcccagctacaggctgaggcaggagaatgacgtgaatccgtgaggcggagcttgcagtgagctgagatcgcgccactgcactccagcctgggtgacagagcaaaactccgtctaaaaaaaaaaaaaaaaaaaaaaaaactcgag

SEQ ID NO: 2564 - DNA, 533 bp, Homo sapiens
ggcacgaggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctaaaaaaaaaaaaa

SEQ ID NO: 2565 - DNA, 4015 bp, Homo sapiens
attgcaacccccactttttttttttttgctttccatttgcttggtaaatattcacccatccctttattttcagcctatatgtgtctttacacatgagatggatctcctgaattcatcacatgaatgggtcttaactctatccaatttgccagtctgtgccttttaattggagcatttaacccatttaaatttaggattaatattgttatgtgtgaattttatcctgtcattatgatgctagcttgttattttgctcattagttgatgcagattcttcatagtgttgatggtctttaacttttggtttgtttttgcagtggctggtaccagtttttccttttgatatttagtgcttccttcaggagctcttgtaaggcaagcctggtggtgataaaatctctcagcatctgcttgtctgtaaaggattttatttctactttgcttatgatgcttagtttggctggatatgaaattctgggttgaaaattcttttctttaagaatgttaagtattggctgctactctcttctggcttgtagggtttctacagagagatctgctgttagtctgatgggcttccctttgtgggtaacctgacctttctcttgggctgctcttaacattttttctttcatttcaaccttggtgaatctgatgattatctgtcttggggttgttcttcttgaggagtatcttagtggtcttctctgtatttcctgaatttgaatgttggcctgtcttgctaggttagggaagttctcctggataatatcttgaagtgtgttttccaacttggttccgttctccccatcgctttcgggtacagcaatcaaatgtaggtttggtcttttcacatagtcctgtatttcttggaggctttgtttgttctttttcatttttttttctctgatcttttcttcatgctttatttcattaagttgatcgtcagtctctgatatcctttcttccacttgatctattcggctattgatacttgtgtatgcttcacgaagttctcctgctgtttttcagctcaatcaggtcatttatgttctttaaactggttattctagttagcaattcctctaacctttttttcaaagctcttagcttccttgcattgggttagaacatgctcctgtagcttggaggagtttgttattacccgccttctgaagtctccttctgtcaatttgtcaaactgattccccatccacttttgttcccttgctggtgaggcgttgtgatcctttggaggagaagaggtattctggttttggcattttcagcctttttgtgctggtttttcctcatcttcgtggatttatctaccttttggtctttgctgttggtgacctttggatggagtttttgcatgatgttggtgttgatgctattgctttcagtttattagtttttcttctaacagtcaggcccctctgctgcaggtctgctggagtttgctgcgggtccactccagaccctgtgtccttgagtatcaccagtggaggctgcagaacagcaaagactgactagaaaaaaatcaccgtgagactagtgttaagcatgagaactagtattaaatgaaagttataaagaatagtgtgtaatgactatatgttttggcaaagaaatataattcagctgtaaaaaacagtgggaagagcatatgcaaaaaattttaaaaactattttctgccatcatacttttgactgtagtgtttgttttgttgctcaggtattttctgtgtattgtgcagcagagcaaatgaataattatacattattctaattttgttatctcctgtgtccttgagagctaggaatcttaatgtggaagaaattatatactgtttatatttatatagatgtaagaaggctaaatcctctacttctgatttttaattagaagtatcagtatgaacttgagattctttaatgtcatttaaaaatagtatataccttatatttgtgtgtatatatatatttgtgcatatgtatatgtatgttaatctgagaatgttttatgtgtattgtggcataaatcaaatgaatatttatgtgatattttaatgctggcatttccttgctatgtctatggaaaagtcccagaaatgaacaaacctagttctgtgaatgtggtcttgaagtgctgttttctgcctgggtgcagtggtccattcctgtagtcccagcactttgggaggccaaggcaggtggatcacatgaggtcgggagttcgagatcagcctggccaacatggtgaggccccatctctgctgaaaatactaaaattggtcaggcatggtggcagacacatgtaatcccagctactcgggtggctgaggcgggagagtcgcttgggccctggagggggaggttgcggtgggccaaggttgtgccattgtactctagcctgggcgacaaaagcgaaactgtctcaaaaaaaaaaaaaaaaaactcgagactagttctggaagaagaaaaatacttctatttgagaaccctattgaggttgcatgccaacttctggagatgttcagacaagaaaaaaagaaatgtggtaaattctaattttacctttttatgtctattttatttacatgacttcttttcagtatccaaaacctaatataaaaaaaaaatcacataatcatttttatgcattcatgtgtaattcaggtatactgtcatattcataactttcaaatgattccaatcaaattcatcctaataatcatctaatattatttactactactacaggaactgaaaaacttatttcatatatatcacttttccatatctatttcacacaaataaacaactaaatatttggtacaacttctaattccacattaaccattcatattttacaacctaaaaatatctataaacaagcacctttgactttgtaatatttacatatgctcaagggaacattttgccagaagatcgtatggttggcttcaaaagaatcttttaaattttcatgtatacttagattaaatttttaagagactagctccaactaacatgagaaatgaaagaatacaaatgactgtaacttttcaataaccttttctcacagactgaaagaatatctgaagaaaacattttgaaattactacttaactattatttgatgtaattctaaaatgtttataaacccgtaacttgtaactttccttccaagaatctttataacaggagtactatttttcttatttgatttgctttgtttagcttagcttagctattaaaatggctaattatactgaagattttacatctttccaacttaaatcagcaatgaatatacatcttcctttcagctacaaggaaacatatacaaatgaaaaatatttaaactgaattcttaagttattagtcctaatatatcccatatgctaacctaagaggcactctccttaattatcttcaaattctcatccttagttcaaacatattccttaaaaaagaaaaaacaaaagattattaaaaattatacttactttagccaacaattcttgtgtttcaggagtcagtggagcatgagaaaacttgcagtattctccctgataacattttgttcctgtatggtaaaacttacaaggatattcatgtaacccaagtgttaaggaagagaacaattttaatccaattgaaataatgttattaacttaatgactttatttttcctaaataaagacctctgtggccgggcgaggtggctcatgcctgtaggaggcggaggtgggcagatcacttgaggccaggagttcaagaccaacctagccaacatggcgaaacctcgcctttactaaaaatccaaaaaaattagctgggcatggtggcgcaggcatgcctgtaatcccagctactcaggaggctgaggcaccaaaatcatttgaacctgggaggcggaggttgcagcgaaccaagattgtccactgcactccagcctgggcaacagagcaagataatgtctcaaaaaaaaaaaaaaaaaaaaaaa

SEQ ID NO: 2566 - DNA, 550 bp, Homo sapiens
  misc_feature (376)..(376): n equals a,t,g, or c
  misc_feature (407)..(407): n equals a,t,g, or c
  misc_feature (516)..(516): n equals a,t,g, or c
gaattcggcacgaggtggagaggacgggcaggtgttcacgtgcccagttaagagtgagatgggtttttatcttcgagtgctacgcctcgtttatgtatttcaggagttgctggggcactgtgggtcagcggctccgggcacctcctgtgcttgaggcagacaccgtctccccgacctcgcttcaccccgtgggtgaaaatgctctgggagctgagaaaaactagtttgtgatcttacagactttcagggctgcacagttttgtaaataggtaaaacactttccagtgttacgattttagtaaattcgtgcttttaaatgatggaaaaaaaaaagaaaaaaaaaaaaaaaaaaaaaaaactcgagggggggcccggnacccaattcgccctatagtgagtcgtattanaattcactggccgtcgttttacaacgtcgtgactgggaaaaccctggcgttacccaacttaatcgccttgcagcacatccccctttcgccagctggcgtaatagcgaanaggcccgcaccgatcgcccttcccaacagttgcg

SEQ ID NO: 2567 - DNA, 812 bp, Homo sapiens
ggcacgaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaagaccaacagggaggctactttggtggcagggagctgactcaccctccagttggaactggtgctaaaagcctccatttaacgacagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctcaaaaaaaaaaaaaaaaaa

SEQ ID NO: 2568 - DNA, 898 bp, Homo sapiens
ggcagagggaaatgtaaactttaggttctttaagtcactgttacaagagcaactcaaatttggaatatatggaagggagattataatgcaaattaatgattattttctatcctaatgtttcatttggctgcttttccaagttattctggatggttactggaccccaagattacctagccaactgtcagttttgaggaagtacctgagatgttaggaagacagaactgcactgtttgtcctcatttctgctttctgctgataaatggattgaaaaggaatatgagataagaaaatgaaacaaatgtatttatttcttgktgcctttctggcttcctccactatttagtttcagttattcagtaggctgcgtaattatacttattcagggctggacaaagggtcagtamcctgataagcgtcaactatttctctgattgtcaaatatgtagtcagtatgtttaatgttttaatattctatgatcaatgatgcataggtttatcaatagctgctaagtttcattgaggtaatttatggaaatttactcatagcaactaacaaacgaggaagtattacaaaagatgacagattaggccaggcgcagtggctcatgtctgtgatcccagcactttgggaggccgaggcgggtggatcgcctggggtcaggagttcaggaccagcctgaccaacatggagaaaccctgtctctactaaagaaaaatacaaaattagctgggcttggtggtgcatgcctgtgatcccagctactcgggaggctgaggcaggagaatcgcttgaacccgggaggcggaggttgcagtgagccgagattgcgccactgcactccagcttgggcaacgagcgaaactctgaatcaaaaaaaaaaaaaaaaaactcgag

SEQ ID NO: 2569 - DNA, 899 bp, Homo sapiens
ggcacgagaagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctggatttttaattgtttggtctttttgtttgtttttaactgcttctgcaggctaccccataggagtgtgcccagaatagcctgttttgtctttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaaatcttttccttttgtaacttggagtgaccttagttttcagtgttagaaattaagtcagaaagcagtttctaaaatttctcacagaaaaagtcagaggaagtgtgttgaaatatcaccaacatggcacatgtatacatatgtaacaaacctgcacgttgtgcacatgtaccctaaaacttaaagtataataataatcaaattaaaaaaaaaaaaaaaaaa

SEQ ID NO: 2570 - DNA, 484 bp, Homo sapiens
ggcacgagcaaaggacatagaattaaggaattaaccttagagaatgtttacattttaaagagtggagaagaatcaaagagtagtcaaatatgatagaaaatcctgggcgactatttctgagttctgttttgttttgtttttttgccctttaagtagctctctttagtaggaaagggaagaatattgacttgggttagttagttctgatttcaaatttcccctttatcacttacttggcagtatttaaccttttcagagtgtttcactgtcagaaaataggaattcagggttgtgaagattacataaaataaatacataaagcacagtgcttgtgacagagtttctttaacttcattagcaccttccctgtgacttcaagtatagacaggacttttatacattagaatggaatatttgtttaactttgtttatgtctcttgttttctccttccttttgcttccacttaaaaaaaaaaaaaaaaaa

SEQ ID NO: 2571 - DNA, 1391 bp, Homo sapiens
  misc_feature (1058)..(1058): n equals a,t,g, or c
  misc_feature (1093)..(1093): n equals a,t,g, or c
  misc_feature (1143)..(1143): n equals a,t,g, or c
  misc_feature (1156)..(1157): n equals a,t,g, or c
  misc_feature (1214)..(1215): n equals a,t,g, or c
  misc_feature (1232)..(1232): n equals a,t,g, or c
  misc_feature (1247)..(1247): n equals a,t,g, or c
  misc_feature (1285)..(1285): n equals a,t,g, or c
  misc_feature (1295)..(1295): n equals a,t,g, or c
  misc_feature (1307)..(1307): n equals a,t,g, or c
  misc_feature (1315)..(1315): n equals a,t,g, or c
  misc_feature (1325)..(1325): n equals a,t,g, or c
  misc_feature (1340)..(1340): n equals a,t,g, or c
  misc_feature (1366)..(1366): n equals a,t,g, or c
  misc_feature (1368)..(1368): n equals a,t,g, or c
  misc_feature (1373)..(1373): n equals a,t,g, or c
ggcacgagatcacctcctccctcctttcacttttcattctgatggtggttgcaccgctactggcttcactccctgggctggggcccctggactcaccgggtgcagggattgtaacgatggggccctggactgtgacgtcaggccaggcggggcggggctgcaactgctccacacatgtagctgcgggactatgcccagcttgggccgggaactctggcccacggctgataagagctttttcagccccagggtggaggctatgctgctgctccttttcttgttctggtccaaaggggcagccgagggggagccgggtcctgtgccagctcctgctggattctctgaaacacaacggtggaggtgagggggcgggggagggccgggagggtggccagggagactgtaccctgggggccatctcaagggccgcagatgggccagcaccaaatgcctctggcacatttggggccaggaactaacaaccaggctgtagaaagaaaggccaagtggaagccgggtgtggtggctcctgtctgtggtcccagctactcgggagatggaggcgggaggttcacttgagcctggaggtcagggctgcagtgagctgtgatcacgccactgcactcaacctgggcgacatagtgagacccaaaaaaaaagaaaagaaagaaaaaaggaagagaagaaagaaggaaagaaggaaggaaggagagagagagagtaaaggaaaagaaagaaagaaaagaaaagaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttggtaaaattcgcgttaaaattttggtaaaatcaagctcatttttttaaccaattangcccgaaatcgggcaaaaatcccttataaaatcanaaggaattgacccgaagaataagggttgaatggttggtccaagttttggnaccaagaagtccnnctttttaaaagaaccgggggaccttccaaccgtcaaaaggggccggaaaaaaaccgnnttattcaaggcccaaanggccccacttcccgnggaacccctttaaccccttaattcaaaaggtttttttnggggggtccnaagggggccccnaaaaggcncttaaaattnggaacccccttaaanggggaagccccccccaattttaaaancntttgnaccgggggaaaaaacccc

SEQ ID NO: 2572 - DNA, 1125 bp, Homo sapiens
ggcacgagattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgttttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaaaaa

SEQ ID NO: 2573 - DNA, 366 bp, Homo sapiens
ggcacgaggctgtgtgttcatggtgtgcctgctgcttagaaccctgtgccctctttgttcaaggggtaaaactggattggaggtaaacctcagtctctttctgtacattgaaggaagagatcaatgatcttcaaaccaatcattacagatttccccagttgaatttgacttagcttttggatgttgagactgataaggtgattgaaaacctggccttaaccacagccaatgatattgagagttcaaggagaaacacacagccttttcaagggtttagaatccgattgggattgggaggaggtgtgtatccacgctacctcatggaagagtgtttctagtttaaaggagacagaaaaaaaaaaaaaa

SEQ ID NO: 2574 - DNA, 1066 bp, Homo sapiens
  misc_feature (630)..(630): n equals a,t,g, or c
ggcacgaggtttcaccgtgttagccaggatgatctctatctcctgaccttgtgatctgcctgccttggcctcccaaagtgctgggattacaggcgtgagccaccgcgcccggccaagccgcatccttttaaattattcatctgttgaaggatgtttgaggtttttcactttttggcttttgtaagtaatatggtttggatctgtggcgccattcaaatctcacatcaaattgtaagcctgaatgttgtaggtggggcctggtgggaggtgactggattatatggttggattctcatgaatcatttaataccattgcctttggtactctctttgccataatgagtgatttctcctgagatgtcactttctttctttgtttttttgatatctcatccatcgcagtttaayctacaaatgaaatttctacagaaacaggaactattttaacaaagaaaaaaatccctcattcagacttctttgggtagtggtaatggctgcaaatttgcagcattwgraaactacactatcaacaagcttycctttawgaactgagatgtmcaaatgtagaaagcagatgaaagtgaattattyctycaacattttagtaaaactyctgataaycagagttcnaagcacataacaactcaagcataaatgaagatggagagcctggggagtttgatttcttaaattttccaaaaaggtattattgcaaacatataggatttccccccattttaaccttaccagtttcaaaggaaagtaaaggtactggattacatgaagacagcatgtgtgcgagtgcacacgcatgcagggtggcaggtagagtgtctaattcctttttcttactacccaagtctcacttcacagaaatcattaggtaaaggaaaaccaacgaggagttctgcagttttcttttaataactgaggctgaggcaggagaatcgcttcaaccctggaggtggaggttgcagtgagccaagattgtgccactgcattccagcctgagcgatagagtgagactccacctcaaaaaaaaaaaaaaaaaaaaaaaaaaactcga

SEQ ID NO: 2575 - DNA, 605 bp, Homo sapiens
  misc_feature (449)..(449): n equals a,t,g, or c
tcaacatccagccttagaaatagctccctttaggtcaccaaattaacaggagtttctaaaggatagcagcttttttgcaactgctgcatctgttagattcatgttctctttgctcccttctccccaagcttctatttcatgatctttttgttgttttgctctacttttcctctttttaaaacctctgcattggccacccaggatttaagaggagcttttctggaaagctgtctgaaacaggaacaaattacacagaaacactgagagctgtgaacttgtgtgtatacctgacatagtgggagaggggggcttccttctaagtaatagagaagagtgaatattctaatcattgagtagtggtcaggcctgtaatcactgctttttcttttgctgagctcggtatcaacggacaagctcaaaaattgtagctatttaaaattactctccangtaaagggttccygttcctttgatcctatcacagactattcctttttttctattgaggaggttcataagatctcgtgggcaagggctgaggagatgactattgcgtagtgtagttgttttaaattaaaaatttacctctagttataggtgctactt

SEQ ID NO: 2576 - DNA, 3116 bp, Homo sapiens
  misc_feature (1342)..(1342): n equals a,t,g, or c
atccacccgccttcagcctcccaacgtgctgggattacagccgtgaagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccagggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgcccttctggttaggtgtgtcaggttggcttattttgggttcaggcctggcgtanacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcaaaaaaaaaaaaaaaaaaaaaaaa

SEQ ID NO: 2577 - DNA, 1073 bp, Homo sapiens
  misc_feature (694)..(694): n equals a,t,g, or c
  misc_feature (1050)..(1050): n equals a,t,g, or c
  misc_feature (1056)..(1056): n equals a,t,g, or c
  misc_feature (1067)..(1067): n equals a,t,g, or c
  misc_feature (1072)..(1072): n equals a,t,g, or c
agctccaccgcggtggcggccgctctagaactagtggatcccccgggctgcaggaattcggcacgagaaaaaacagatgagagcctactcactccaaggggatggttttaagccactcatgggttttaagctcccatgatccaaacacctcccaccaggccccacctcttaacactaggctggagtacttgctttctagtgtggtctcatgagattcggacaggggcacatatccaaaccatgtcacatacaattcaaagaattatagcaatgtgtaagtaaaaagatcttaatcttttgtagtaaaaacagaatgaagaagtataaatggtgaattttcatcttggaggacaggagctatataaaaacccatcatgaaaagtctcagctttgtatctgggagaaacacatgatgaaaacgagcttgttatgttttttgttctctkgtaggcctagtcattcattttgsatgagttctaagccctggttaacaatctcccttggtttcttctgtagctcttattataccacactagaaaagcaagtactccagcccagttcccttactttctaagtctttttccattttcaagccatgtgtgktatgtgctgattttggaatggtctggaatgctctcttcttaacctcaacctctctgagaccttaccaatccgcagagtccactggagtctnacctycaagataacttccccaacctctctgagaccttacccatccgcagagtccactggagtctcacctccaagataacttccccagccacctaaaccaagccccagcatccccagcatcactctagtgcttagttattattcggggatgaggtgaggggttgctagatccacatgaaaactctacatgctgtgaagtgcagtacagatgtgagagggcaacactgttttccttgcattattatttttgttttacctgttatgtgtttgtcctgtcatccccttcccccacattatgaccctcctagaggtcaaaagctttatgtttcttaacccatccccaagtgcagaaaaggnaggggnaccgaacccgngtcgna

SEQ ID NO: 2578 - DNA, 2195 bp, Homo sapiens
  misc_feature (2169)..(2169): n equals a,t,g, or c
  misc_feature (2179)..(2179): n equals a,t,g, or c
  misc_feature (2187)..(2187): n equals a,t,g, or c
  misc_feature (2192)..(2192): n equals a,t,g, or c
ggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgtttcccataatttgggcctatgctatcctgttgatttttatgtctagcttaaaaggtatttgaaaatgttccatttgtgttttattattttctgtcctatgacagttctatgctaaatgtattttaaaataaaagccaaattgaagattaaaaaaaaaaaaaaaaaaaaaaaamcycgagggggggcccggnaccaaattcncccaaaanggggnccc

SEQ ID NO: 2579 - DNA, 1057 bp, Homo sapiens
ggcacgagccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagcttcctctggggcattgttaaaggttcaccctctttttttgtggggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaaaaaaaaaaaaaaaa

SEQ ID NO: 2580 - DNA, 1626 bp, Homo sapiens
  misc_feature (1102)..(1102): n equals a,t,g, or c
  misc_feature (1206)..(1206): n equals a,t,g, or c
ggcacgagcccgcttcaggagaaactgtatgtgccatcccttttctcagagcattatgcacagataattgtgtaactgcatgaaacatatattaaaattaggtcagaagtaaagtatggttggaatttgggtatgcgtctgccacttgtctgtgtctcaagcacttaaaaacatatcctattcctggcacagttcagtgcatttcgggaagtgaccaatagtcagggaaataatcaaggtttctggaacaaaatgcaagagttggcctgagatcactgctctacctagagaggagtagggcaaggccagtctkggccatgattcagagtaaggatgactgacccagccacaggggaggacagtgcccaggacctgtgtactcctatgttcccaatgcctaagagtgcccagcccatggaaagtgttcagtgaatttaatgaataaatgattctacagaaatgggcacggggaaggagaaagggcctgcagtcttttatttttattttattattttttttttgagatggagtctcgcactgtcgcccgggctggagtgcagtggccacaatcttggctcactgcaacctccaccttccaggttaaagcgattctcctgcctcagcctcccgagtagctgggattacgggcgcccgccaaccacgcccggctaattttttgtatttttagtggagatggggtttcactatgttggccaggctggtctcgaatgcctgacctcatgatccgcctgtcttggcctcccaaagtgctgggattacaggcgtgagccactcgcccggycggtcttttattcttcatacaagtgtccttcctgcacatcccagagctatctaagacccattctgatcatcactaatgccagttccctcttctgtgaggggcagtaacacccctggtgctgcctacctcacaggattgtcctgagagaccagcgagattctgcatgtgaaggggctttctctgaatagtgaagttctacaatgtgactcatctttgcggaccctgcctycacgtgagggtgggagacctctgctyattgscatttcttttcagattctgcartgttaarttggaaggtwnccacggaagccacattattattacataggaagtgacatyactttccarcttgttttggggggccaaaatcttgctatgktcttggccagcacctcagtttccancctccttccaacccattgtctttctttgtaactctgcctaacaggtctgggaggtccaactttgactgaggatgttaccttcccctccccagtgctgacctcctccctcctagttacttggcataccgggaaccacatcatcaactcctgtgggtaaaaggtgacacatgagccataacactgcttgctttcccagagatgcctgggtttccaggagctgccacatcactcttcctcttttgcatcttaatgttggcagtgggaaagagttagaggtggattcctggacccagtctggcctgcattatttcagcatgtggaatagaggtcactaaccggtgtgccacaggctagtctcagcttgcaaatgtattttgtctccataaaaaaaaaaaaaaaaaaaaaaaaaaaaaactcgag

SEQ ID NO: 2581 - DNA, 1692 bp, Homo sapiens
  misc_feature (23)..(24): n equals a,t,g, or c
  misc_feature (72)..(72): n equals a,t,g, or c
aaggggcaaaagctggtagctcnnccgcggttcgtcgcgctctagaactagtggatcccccgggactgcagnaattcggcacraggaactcctggattcaagcaatcctctctccttggcttcccaaagtgctaggattacaggcgtgactctggcacccggcctcagtgtgtgctcttaattgctacactgtgccgccacttggcaatgtcacggccgcttactcttacctatgcaatcctagcatgcctttccttcttctgcttcatgctattgagcactctttgtcatcccacagaattcagttcagccatttgagaaaagcctttcctgactctaacagacaagttatgcacctctttcctgtgcttacatagtagcctgtaccaacattacatttctcattgcattatgattgcaacatctgggcacatctctctaggacgctcagctctgtggaggcaaactctttctcattcagtttgtatgcccagtttaacacctaagcgttagcacacagcagatacttggtaaatgtttgttagctgagtaagggaaaaatagatcttctagccatgaagttttaatagtgttgatgtaaaccagaaggaacatttcaaataaattatgtaattttcaataaaaaaagatatacccttgatctgtaactcacaaaaataatgtattcttctgaaacagtatacaacgaatgtttaattaaccatttgattaaatggctgagtaccctgggccaataaagcaaagtttcattaactcctctaatattcttaacggaaaacctgaagagctgacatatagtagtaaatgaaatgtgggttggtatctcagaccatcacaaatcacctcttaatacaacttcttatcatcacttaacttgaaatactttcaaagatgaagacaaagggtaataaagaagtagcaggatggagttgtactcttggtataagagaaatatacagcaagtcattataatacattagttagtaacagtgacttttctaaggtttcagttgatggttattcatccactacttaattctttcctcttaacaacctaaatgaaaagtcactgcttttaaaataacattttgtcataactctataaaacttttttttttgagacggagtcttgttctgtcacccaggctggagtgcagtggtgtgatctcagctcactgcaacctccgcctcctgggttcaagcaactctcctgcctcagcctcctgagtagctgggactacaggtgcacgctgccatgcccagctaatattctgtattttagtagagatggggtttcacccgttgtccaggctggtcacaaactcctgagctcaggcaatccgcccacctcggcctcccaaagtgctggrattacaggcgtgagccaccatgcctgaccacattaaagcttttracatgctaatctgagtggttattgatgatggtaagatcaagttcggttgttttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagatcaaaaaaaaaaaaaaaaaaaaaaaaaactcagacggggg

SEQ ID NO: 2582 - DNA, 975 bp, Homo sapiens
  misc_feature (813)..(813): n equals a,t,g, or c
  misc_feature (843)..(843): n equals a,t,g, or c
  misc_feature (917)..(917): n equals a,t,g, or c
ggcacgagcctatctccttacagcccgcagacacaaggtaggcaataaaaaatggtttcaactttttcagtatttttacaccaaaagatgctgtcttacaagacctctatcttttgtttgttcctgtttttccctcccttcctcaccaggggagagaaaaaaacggaaggaaagaaaggaggaaatgaatcttaatgagcatctgctgtgtgctaggcacttttaaaaatacctaaggtcatcagataatttacacagaacttgggtggtagtgtgtgaaagactatgcataactgagatgattccatggcagaaaattccaagccatggaaaaaccacatcgtatttatgatggtgcacaaaccgtgatgaagaagagcaagagggaggaaggaaggacagatcccctatcgaatggcaatacttgaggattggggggtaaaaccctaaatgaacttgtagattaattcaaagccagacttactgcttctatagagagactagcacattgtttatatatcagaaagtcctgaattaatttcatgcttaatgccaaaggggttgccataacctttgcctctaagcaaggctgtctctaaataatcatcatatttttaaagttactcagattgcaggatttcctttgacagcctatttctgcttatatcacttttactatagggtgttttgtctttatttctgattttctacccccttcaaccaaagtgtgtttctgcaagcctgttctttgtggaactaatggcttttttttttttttttttactgaattataaataccatgaggactttgtntctcccacagttctcatagtaagctttgcncagggtttatggcctgtaaatatttgttgaatgaacagtggaataaataaataaataatggtgatataccaatntaaaaaaaaaaaaaaaaaaaaaaaaaaaaaaaaaaaaaaaaaaaaaaaaaaaaaaaaa

SEQ ID NO: 2583 - DNA, 1276 bp, Homo sapiens
ggcacgagcttgtatctatctatatacacactttataaataaatgagtcaagatttttaaaacaaaataccaaatttttcagtatcatttgaaatttttcaaaattacttttttaaaatttctgcatattcattcagtgaagttgaatgatccagtgggcactctgtattccttcataaactgtgtggtgaatgtgcgtgtgtgtatgtatgtatatgcacgtgtttatgtgttttctggggttaatttccttaaaataaaaaggcaactgtcaagactaaagctataataatttttatgaatcttagaaaatgttgaatttttagtgattccagaaattgatctctatcgatgaaactgctttctcaaatacgtcagcaatgggattcaggctttgcttacaatgtgaaggaagttcttagtctcatttgcacaaagaaggaaggagggctaaagataaaaagaactcatagtcttttccatagttttgggtcatgttcactgtaaaaaaaaatcacaagatgccatttttacacagccttttaatctacacatacggcagctaatattccaaaaaaataatttcttcctttgtagccatttaaactaacagctagaatatttcttctcccaattattaaaaataagctgtttctgagtcggtgctgactacatttactgattgaagcagccaactccaaatataccatcttttagtattgacacttaaaataaaacttctccccagaaaaagagttctataaatgatggctgtagaaataggcactgtccaggcagttgttttgtggaagtagtgttgttattttctggtgttttccaagtcatctcagatggtgcgtgaaaatgagatgccaaagaaggcttaaaaaagataccctgcaccagcttcagaatgtaagcaaatctttcattccagcgcttaaaagttttgagaaagctaatctaaagttaaatgtttactagcatctctccgattatattttagaaactactgcacaaaaataaaacaaatttcttattttctctgggttgaaaagtgcacataaaatggaaaatgctttttataccactatttccagcagggattttattttcatttgtcatttgccagcctggggtatgttgggagaaggaacaattgatttttgaaaaggtgcatttgtgtgaaaaccaaaaattgtgttcaacaaatactactactaacccatatgtggatatatgtgttttatacatgagtaaaaaaaaaaaaaaaaaa

SEQ ID NO: 2584 - DNA, 1212 bp, Homo sapiens
  misc_feature (551)..(551): n equals a,t,g, or c
  misc_feature (730)..(730): n equals a,t,g, or c
gattatctgcttctaggttgctaaatatcaatataaagcatattattccagtaagtgccaatgcagttgttagatgctggcgctgaagttagtgctcactgcattctctcttgttggctgtctacttgagtcaccgattggcacagccagagctataaccagtctgtgaggattgatttgccctgacttgtatcttcatgtgtggtctataaggtctgccagattggcttatagtcacaaccagcatgtcctaagcaaaatgaaactatatgaacaaaaatcagctctcatttcactgctagactttggtgttttctttaagaagtagccttgttaatgcttagttttgccttggggrccttaatgtgtcattaactgcctggaaatacctttcatttaaaaaagtatactttagtacctaatgttcaatttagtatcgatctggatattttagcaaattttgacttttcaaagacaaagtttctgtcttgtaatgtttcttgggccggctatactgcctttcatctaaaactcactacagttcactgggnccgtttggtaacagggtaacckgggcataattaggtgcttgattgacaagagagttaccagtaccagaagtcaggttctattttaaccccatcatttccaattgattgtttttctctccaccattattcactgtctctcaagtgttagcactctgagttgttgaacggaggtttgtatntgcgcagagccctgtcgcaatgccccagcaagcttcttgttggcatgtggccactctaaattgtgctccaggatctgctatgggtccatgcttgcaggagaaacagctgtgtagaatttcctattgcatttcatttgtgggtttagaactcggttgcttatttcatattgtctcccttttcagtccttcaaggtacatttttccaacttctctaatgaattattacatttctgagtagctgatatgtttttatcttatctaagcagtatatttataattccttctttgcattggctaatctgattagtagttcagaacccaattttcagattgtctatagcaaactgtgaagaactgtgctgtcaagtagaaatagaatataagccacatatgtaatttaaacttttctaataccacattaaaaactataaaaggggaggaaatggaaaattagtaaaaaaaaaaaaaaaaaaaaactcgag

SEQ ID NO: 2585 - DNA, 575 bp, Homo sapiens
ggcacgagctcgtgccgctcgtgccgtgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaaaaaaaaaa

SEQ ID NO: 2586 - DNA, 519 bp, Homo sapiens
ggcacgagggaacaattgcatcaccccagaaaattccctttacagacagatctgtccctccaaacttagcctctggcatcctctgatctggttcctgtgactctaggcttttctgatgtttgtttgttggccttttctagggtttcctgtaaatggaatctcatgtcttctgcgtctgggtactttgacttagcatagtacttttgaaattcctccatgtattgcctgtgtcccttcttattgccgagcagtaatccactgtattcctactgtggattatgttccaccgttgtttatccgtccaccagatgatgaccgttgggttgtttccagtttttggctgccatgagtcaagttgctataaacgtgagagtgcaagtctgtgtgtgaatacacattttcatttctcttgggtgcatgtaacagtggggttgttaggtccaatggtaactgtatgcttaataagaaactacctgattcgctgagagagagctttaaaggaaaaaaaaaaaaaaaaaa

SEQ ID NO: 2587 - DNA, 1104 bp, Homo sapiens
ggcacgagatttccttatatatgctagatagaggtgtcatcagatacatgatttgtaaaaattttcccttgttctatgaattctatgaattatcttttcattttcttggtgtctttggaagcataaaagtttccaattttgattttgtccagtttttctatttttcttttgttgctcttgcttttagtgtcatatctaagaaaccaatgcctaatccaaggtcataaagactatgtctatgttttcttctaagagtttggtaatttagttcttacattgagatctttgatccatttcaagttaattctgtgtatgatgtgaggtaggagtcccttagcttctgcatatgcacttttcccagcaccatttattgaaaatactcttctttccccatttaattaccttagcacccttatcaaaaatcggttagctatagatatatggtcatatttctggactcacaattttagtccattgatatatatgtctatccctatgcctatactacattgttttgttatggtagctttagagtaagtataactgctttatgttaaaatattaacctatataatcttctgccagtggtaggttttcccttattttctcatttttgagactaattttccaacttaatttggcttatagaaacctacaaaaagtattgttaaatatttttcattttcttaatactgcaaatcaaactcaaaggaaagttgggagggggtgtgctgtttaactcaggcaactagtgttctcagaatatacctgggctccaaatatgaatcagtaagggagatctatgcttggcgcggtggctcgcgcctgtaatcccggcactttgggaggctgaggcgggtggatctcgaggtcaggagatcgagaccatcatggccgacatggtgaaaccccgtctctactaaaaatacaaaaattagctgggcatggaggcgcgtgcctctggtcccagctattcgggaggctgaggcaggagaatcgctttttcccgggaggcggagattgcagtgagccgagatcgcaccgctgcacttcagcctggtggcagagcgagaccccgtctcaaagaaaaaaaaaaaaaaaaaa

SEQ ID NO: 2588 - DNA, 865 bp, Homo sapiens
ggcacgaggaaaggctggggaaactcaccatccattaagcagaatgttttttggtccccctgtttttagcatggtccttcatctccacctccagctgtgtctggtgtccgtctgcaagtccaaatccttggttcaaccattccaggcaacctggccaaaactaaccaaacacccatgatctcccgagaggagaaaaggcagctgcctggccacaggctggggaagggaatcaggtcatcctgctcctttgccagacttttgatcgctccacctggatttagccctgtggcacagttgtgccttcgaagatgtgtagtgccttcatgtgctgagcttttctggggggcctgtagctttattctgttttcttcttcttagcttctcattctgtacacatttagatctcatttttctcttgtctgctttatatcttctttaattttgctgatgtctgtcagctgcatcatttcttctcccaatctctttgtgtttataggtttacacctttcattatttcttgcctgttattttagtatgtttcaagagtgaacagagggctaggcatggtggctcacgcctgtaatcccagcactttgggaagacgatgtggatggatcatttgaggtcaggagtttgagaccagcctggccaacatggtgacaccccacctctactaaaaatgcaaaaattagcgaggcatggtgatgcgcacctgtagtccccagctactcaggaagctgaggcaggagaatcgcttgaacccgagaggtggaggttgcagtgagccgagattgcgccactgcactctaggctgggcgacacaacaagactctgcctcaaaaaaaacaaaaaaaaaaaaaaaaaa

SEQ ID NO: 2589 - DNA, 3244 bp, Homo sapiens
  misc_feature (343)..(343): n equals a,t,g, or c
ggcacgagcaaagggggaaaaaatggccattatgttgcaagcctgagtacatcttacctggatgccatgcccttcgtagcctggttttgtttttgtgtctttagcaccattcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctawgtttcaggtggttaatggaatgaangggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccaygccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaaaaaaaaaaagtcgagcggccaagaatttagtagtagtag

SEQ ID NO: 2590 - DNA, 3229 bp, Homo sapiens
ggcacgagcaaagggggaaaaaatggccattatgttgcaagcctgagtacatcttacctggatgccatgcccttcgtagcctggttttgtttttgtgtctttagcaccatwcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctatgtttcaggtggttaatggaatgaagggttgcctgtcctgtagctatatcgagaagtttactgactttcttcggctctttgtgagtgttcacctaagaagaatcgagtcttactcccagttccctgtggtggagtttttgacamttttgttcaagtacacatttcatcagcctactcatgaaggttacttcyctkgtttggawatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagcctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaaaaaaaaaaaaaaaaaaaaaactcgag

SEQ ID NO: 2591 - DNA, 1545 bp, Homo sapiens
  misc_feature (835)..(835): n equals a,t,g, or c
ctactactactaaattcttggccgctcgactttttttttttttctagaacaacaacataggcattttatttcttttcattaagcttcttagtttcttagtatcacaatggaatgatgagaaaacaacaaaaacgtgagtctttgcaaatctctgacaaagagcagagatctcaaggcaattggggcgggggaggcttgacagaagtgccagagcagttccaacgtcacatctctccttggctggaatggtgagaaggtggcactgtcgtgagctgtccttggcaattctgccccatgagccacgtgcgcctggtctgcatgggccaccccgcgggatttcctggtgcctcctagtacctggccacacacccctccgcctgctccaacgccctgggagcaccgtccagtgctcaggtggacccagaagccagctctgctgggcagcggcaagatgtggaggagcggcagaggcaggcagcgttgcttgcggtgggagaagccaaggagtgtgaccaaggcccatctgggagacatctgtggtggaaggtagggctggcgcaggtggcagcagcagaagtccgtgtccccaggcagtagcaggcctagagcttcacagtgccagggggcaggctgtcgttgcagagtctgtagtagcgcaggtcgttgaccagcctgtgcacattctgggtgaatgagggcaggtcccgatccatcttgaaattccgccccagcacacttttctggttggcatccacaccatcacagctggtcaggaactctgggaggaaggcggcaaagaagccatcaaagtcgactgaggccatgttgtagatgncgatgccaatctcctcctgcagaagatcatgggacttgtggaccaggacctggagcagcacgttcacaaactggaacagcatggcagtccggaagatcttcttgtggtacagcttctgcttggtgttgagagtctccaagtagaagagattttgtttaaaaaggtggatgtcgggctggagaaaggactgtccgaaagcctgcatgatggcactgaactggggctcattctccatctgctcctcagcgatccccctctggacactggccagcacggtggacttgaagaagtacctccagttgtgatggagcgtccggaaaaggagctcaaacagctcggccttcacatcaggggagggacgctcggcaatgatgggatacacttgctccatgcacagggcgatgatgctggggaggaagggcttgaacacctggcctggctcctggaccaccacctgcaggatcttcagaaacttctccaccacccggcagcctgtgctgccctcgtggaggatgctctcggctaactgctctctggtaaacatgttgaggaaagtctgtatgatttgctcagtgaaaggcacacccatctgtactctaaggcctcgaaacagagtgaggaagaagctcagcatctcatcagtcacatctgactgatggataaaagctggaaagagggccagggagacctgaacagattcctgcagcgac

SEQ ID NO: 2592 - DNA, 3304 bp, Homo sapiens
ggagctccaccgcggtggcggccgctctagaactagtggatcccccgggctgcaggaattcggcacgagcaaagggggaaaaaatggccattatgttgcaagcctgagtacatcttacctggatgccatgcccttcgtagcctggttttgtttttgtgtctttagcaccattcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctawgtttcaggtggttaatggaatgaagggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaaaaaaaaaaagtcgagcggccaagaatttagtagtagtag

SEQ ID NO: 2593 - DNA, 3303 bp, Homo sapiens
ggagctccaccgcggtggcggccgctctagaactagtggatcccccgggctgcaggaattcggcacgagcaaagggggaaaaaatggccattatgttgcaagcctgagtacatcttacctggatgccatgcccttcgtagcctggttttgtttttgtgtctttagcaccattcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctawgtttcaggtggttaatggaatgaagggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccaygccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagcctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaaaaaaaaaaagtcgagcggccaagaatttagtagtagtag

SEQ ID NO: 2594 - DNA, 3304 bp, Homo sapiens
ggagctccaccgcggtggcggccgctctagaactagtggatcccccgggctgcaggaattcggcacgagcaaagggggaaaaaatggccattatgttgcaagcctgagtacatcttacctggatgccatgcccttcgtagcctggttttgtttttgtgtctttagcaccattcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctawgtttcaggtggttaatggaatgaagggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccaygccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaaaaaaaaaaagtcgagcggccaagaatttagtagtagtag

SEQ ID NO: 2595 - DNA, 815 bp, Homo sapiens
ggcacgagaacagccctctggggcaagagcatacctgtgatcataacaggaaggaaaaagctgggaagaaaagaaagaaggcagccaatgaagagatattcagaatgattgttgtcctcgccactccatggaaattgctcttttcaaagcatcagtgacttctgtcttgccaaatccaaatgtcgtatcttttacgacttttagcaacattcaaaccaggtgattactatgcctttattgcaactttttttattctattatttccttccttcctaccttccttcccttcctcctgagacacacaccttcctgttttttcccctaaccataccaggcattttttccagaaccactttcctggaggttcttctgctcctgattctaaaatttgcagtgccttggctcttctccttctaaacacactctttagcaggtcctgtctatttgtttccaaggctgtaaattcctcctgtccattcatgacttccaagtttataaccccagccctgacttctctgtgctcaagcctatgcgtgcacacacgcgcacgcacgtgtgtgtgtgtgtgtgtgtgtgtatgttactgcatagttgagctttctagtgcaatgtcaaacaggcagctcaaactttatatgtgtaaactagaatcattgttttttgaatcaagactgcttcctctccaactgttcctaccccaaccatcattccccctaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2596 - DNA, 1433 bp, Homo sapiens
ggcacgaggcaaaatcttacatgtttaacaacatataattttttgtatctgaatttagaataaatcattttaatgcatcttaaatcacgtcacctaatcataatagttgtggtaactaatcattagtgcagagcatgcagataaaaaatatttgaatttttttttcttggaagtacatgtagttatgagtaggttaagagaatatctaattttcctactctttttttcatctttagcatttaatgttgaaacaccattcacgtcacattaaggacccactgaaaatgtattgttttaatgcataattgacttacctaattaaacatacacacaaatttaattattttttttctcttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagcttttttttttgtttatgattctgatcaactataagacacaatgtaaagaattgtggcttataatttatctgaaatttattagcttagtttagtttgggcaggagttacaaacttaataggaattgtcattttacttacagtttatttcctgattagttgttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtattttttaagaccacataattctttttgtctgctcaaggaaaggatagataaataattggcacacatttgtttctcactgaattttacagtagtaaattaatgttataatgtaccacatggagatgagttggtaagaaatcatctagttctagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagcataaaaaaaaaaaaaaaaaa

SEQ ID NO: 2597 - DNA, 1862 bp, Homo sapiens
ggcacgagctcgtgccgcttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttctctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggttacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaaaaaaaaaaaaaaaaa

SEQ ID NO: 2598 - DNA, 1201 bp, Homo sapiens
ggcacgaggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaaaaaaaaaaaaaaaaaaaa

SEQ ID NO: 2599 - DNA, 1969 bp, Homo sapiens
gtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcggcacgaggagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactgaaaaaaaaaaaaaaaaaaaaaa

SEQ ID NO: 2600 - DNA, 1166 bp, Homo sapiens
ggttttcaactcaatgtctccgagataagagcaggacccggacagtaggaatccacaggctgtgtccctaccatgtaaccagcgaccctgtctccacaagtctgccttttactatgccttgtatgcactgcctcctctctagttgcattctctctgcctgcttcagcccttgcatatctattccctgggctcctccagtggttcctgtgtagtctgtgcctccaacccagtggtttctaaccagagaactattttgctccccaggggaaattcagcagtatctggagacatttttggttgtcaagaccagtggggtccttctggcatctactggatagaagccatggaagctactaaacatcctacaatgcacaggaatcccacaaaaagaactgtctagctcaagaggtcggtggctctgaggttgaaaaactstgctccagccatatctgcctctaatccattctctacacatcaccagagtgatacaaaatacaactcccatgccattgatatcatttcccatacctgaaatccctcaatgcctcctagctgctctcaggttaaagtctaaattctcctgcaaatcacacgaggcccataatctggccctctcctacctttctacctcaccttcaccatcccccagaaccctcttccctgaaaccacactcacacctcatgcaggtgaaacagaccactccgttaccaactcttcctgtccatctctcccatttattccttagcccactgattttatgtcagacactccaatgggactaaaaaggaacaaatgccctcaaggcagctcaaggcactgatatccagtagggcacacagaaaagtgggcacacaattcaatcagcagaggcagaactttgtcatcgcctctgtgatcccactgccatctccccagtggactgtgatcctccagaagagagagcatcttcatgtcttcatctttatagtccacaggaacttggacatggtaagtgtggtctacagggtgtacaacttgtatttgtcacaattgttgcattaaggaatgaatgaattcccagcctctttaagtttggctctagcacagaaataaaaagaaatgaaacattaaaatatagagatgaaacaaaattcttcatagtgcatgcactcaaaagcccagaaac

SEQ ID NO: 2601 - DNA, 1144 bp, Homo sapiens
ggcacgaggttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggataaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaaaaaaaaaaaaaaaaa

SEQ ID NO: 2602 - DNA, 1930 bp, Homo sapiens
  misc_feature (9)..(9): n equals a,t,g, or c
  misc_feature (1922)..(1922): n equals a,t,g, or c
aattgagtntgtggcatttgctgtgtttttcagcaaaacttcatcccaaatcagacatcttaaggcaccaataatttgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccaaaaaaaaaaaaaaaaaaaaaaaaaaaaaacccngggggggg

SEQ ID NO: 2603 - DNA, 1753 bp, Homo sapiens
  misc_feature (909)..(909): n equals a,t,g, or c
  misc_feature (1063)..(1063): n equals a,t,g, or c
  misc_feature (1151)..(1151): n equals a,t,g, or c
ggcacgagtttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagctattaccctgaatgaaccgacagaattacattccattttggggngctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttntaggcagcttatcctgggccttgctagtagaaataactcttaccttattttgttaatttcccttttctattatggaaattaatacagngtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaaaaaaaaaaaaaa

SEQ ID NO: 2604 - DNA, 1501 bp, Homo sapiens
ggcacgagcttccagcttagaccaagccaacatcttctctcatctggaccactgcattagctttccagctgatctcacagctttcagtcttgccccacccgccaacactacagccaaagcagtccttcaaaaatgtaaatcagagtatgtctgaagcttgcttgaaaactttccagtggcttctcatcacactgaggaaaaagtccaaactcctttccctggccaggaaggtcctccatggccctacatttcagcctctgatccccagcctgataactcacatgccagagttattcttgttggtccctcttcctggcacgctcctccttagcctttcacatggctggcctctctcacatagtccctcttcatattctgagaccactttctgaagttacctcatttctcacttcacttgtatttccatgaccttgttttatttttcattatagtactatggctattgaaattatatacctgtctgttcttgcctactagaatagcataaggcttcatgagaacaaggactgtgtctgtcttggttcccactatagcccagagacatactacattggacgtatatattaagtactaaataaatgttcacagaaagcatgaatttaaaaattaaggatagattatgagaaaagaaaaaagttctggagccaagacattgctttttttttttttttttttgggacagagtattatctctctgttgcccgggctggagtacagtgatgcagtcgccactcactgcacgcagcctccgcctcctgggttcaggtgattcttatgcctagaccacccgagtagctgggattatagacccacgctgccacgcccagctaatttttgtgtttttggtggtgatggggtttcgccatgttggctaggctgacggtctcaaagtcctgaccccaattgacctgcctgcctcggcctcccaaagtgctgggattatgggcctgagccaccacacccggccagcactgctttctaatagaaaaagaaacaacttggaagaaattagaagaaatgcagtatgttgaaccaaaacatagcaaaggattattagaagggcagctgatgctggataaaggaaaagatattatgcatcaaccacctcatagtgctggagcagtagtttgagggttgaaggaacagtgaggatttaactagaaatataatcttagtactcaagacctagaaaaaagagaatgatagtctgccaccagattggtttcccttaactctttaatttgtatcttcaaattctctctcacctagcctggccaacatgatgaaaccccatctctgctaaaaatacaaaaattagccgggcatggtggcgcatgcctgtaatcccagctacgtgggaggctgaggtaggagaatcgcttgaacctgggaggaggtggttgtagtgagccaagatcacaccactgcactccagcctgggtgacagagcgagactccgtctaaaaaaaaaaaaaaaaaa

SEQ ID NO: 2605 - DNA, 1450 bp, Homo sapiens
gctcaaactatgcattaattttgcgtgcatagttctaataattttaattgtctcatccagtcgaggggttgacagactagaacagaccaggctcagttcacatgctgcctatttttgtaacacttttttttgtttgttttgttttgttttgtttattttgccctacaaaaactgatttgagtagttgtgacacaactatgtgagactgtattgagactacatggcctgccaagcctaaaaaatatttacacctgaccctttacctgaaatgtttgctgacctctgaatccgagagttgaagggaatctataaaagtggctcatattaccaaactcgtagagcttgtgaagaataatgcaaatctattcatttatatattcttttccagtgtttttagaaggctcactgagcacagtacctcatattccagatccaaggattcctgaggaatccaaattagtatccmsaaggttcattggtagtcatggttataaaccagagcaaaagttaatgggaagaaatggtaaagagtyactkyattgcagctgacacctgggattttaaaatctttttttcgtttttgagatggagtcttgctctgtcgcttaggctggagttcagtggcgcgatcttggctcactgcaacctctgcctcccaggtgcaagtgtttctcctgcctcagccttccgagtatctgggattacaggcacgcgccaccacgattggctaattttttatttttatttttatttttatttttgagacggagtcttgctgtctcgccaggctggagtgcagtgacatgatttcggcccactccaacccccgcctcccaggttcaagtgattctcctgcctcagcctcccaaatagctgggactacagcgtgcgccaccacgcctgggtaatttttgtatttttagtagagatgtggtttcaccatgttggccaggatggtctcgatctcttgacctcaggtgatccgcccgctcggcctyccaaagtggtgggattacatgtatgagccaccacgcccggcccacgctcggcaaagtttttgtatttttggtagagatggggtttcaccatgttggtcaggctggtctcgaactcctgacctcgtgacccgcccaccttggcttcccagagtgttgggattacaggtgtgagccaccgtacccggccaaaatccctttagttctagtcagtagaggaataaagcactgttctttcaaatgtgaacccctcttgatcagtattgtccaatctggcctgttctttaaccagtcagcctcttttcctgcctcttgcatgggctttttgttgttgtttctttgtttgttcatctatcatctcttgctttaatcataacctaactttccctgatgtggcacgtgtaaaactgaaaaacagaaactctatctggtaaaaaaaaaaaaaaaaactcgag

SEQ ID NO: 2606 - DNA, 2329 bp, Homo sapiens
ccgggcctgcaacctgccggggcggctccgctacgcgcaccgcctcagtggcttcctccacagccacctccggaggatctggctgaggaggaagtggaggtgtcactggccccggcctttgccccaatcttgtgtgggcactgaagggggactacaggttcgagatacttcctcgcgtattgctaaaggaggagttgaccacaccaaaatgagtctacatggtgctagtgggggacatgagagatcaagagatagacgaaggtcaagtgacagatcacgagattcatctcatgaaagaacrgagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgttttaaaaaaaaaaaaaaaaaaaaaaaaactcga

SEQ ID NO: 2607 - DNA, 1593 bp, Homo sapiens
  misc_feature (322)..(322): n equals a,t,g, or c
  misc_feature (1131)..(1131): n equals a,t,g, or c
gaattcggcacgagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggtcantggaacctgaaagtggacttgagcaggttctcatgcttctacctctggccttatccctcaggkttcatgtagcttgcgacccagccaggcagagagagttctagcagaactacatacaaatggtttatgaagtttggatttatccagacaatcatatgagttagggtaaagatcttaaggaaagagagaggcctgggattgtggactaaggcagaggagggacagaaagacctagagtaggtctggcactggaaggtggtattaatacatttcttttcttctcccagttgaatttggccagcactgtttcttttgactttagagattatttcccaatgtttgatgaaagttttgaaatctttagatatgttgggaaaattgtggacagtctttcaacatagtacaagttccttttccaccagctgaggtactggcagctataattttaattccttttctagttggtaagttttctcttcagttcagccatcctttagagctccttcacccagctctctctgctctctctgtccccttcatcaccaagacagacattctgggtcagagatggaggttgtgtccttgtcaccacatggaggaattctgtgatcagaagcagagcacctgtgttttatgcatttaaaaacatctagaccgggcacggtggctcatgcctgtaatcccagcactttgagaagccgaagcaggtggatcacctgargtcaggaatttgagaacagcctagccaacatggtgaaactccatctctattaaaawtataaaaattagctgggcatggtggcgtgcanctataatcccagctactcagraggctgaggcaagagaatcgcctgaacccggcaggtggaggttgcagtgagccaagatcacgccactgcactccagcctgggtaacagagtgagactctgtctcaaaaaaaaaaaaaaaaagccaaacctctagaccaggcgtggtggctcatgcctgtaatctcagcactttgggaggccaaggcgggaggattgcttaaggccaggaattcaggaccagcctgggcaacatagtgagatcctacatcatctctacaaaaaataatttaactgggcatggtggtgcgtgcatgttgycctagctacatggaaggctgaggcaggaggatcgctgaagcccaggagttcgaggctgcagtgagccatgatttcatcgctggaactccagccggggcaatacagcaagaccttctctccaaaaaaaaaaaaaaaaaactcga

SEQ ID NO: 2608 - DNA, 1583 bp, Homo sapiens
ggcacgagccttaacaggagtatttgagaattaccttataaatgcagagaatgaacatgaaaagcatcagactttatctagacttaagatattattagaaaattcactgaacactagataaagttaagtcctaaattgtttcttaatttattcatgaattctttgagtttctgagatagaaatttggagatcttggtaatgggcagtggtatactttgggaagtaggaaggccagttgatttgtgctttgatggttgttggaggtcattccatgattggaatgtgttgattttcttgatttatttgttattacaacaaagcagttattcttggacagttgacatttcagaactaaacaatccttaaatatacttggaattacagaaatggaattacttggcacgtttgtttaataatcaacagggcagtcctgtttaattattttcacacatttgggtcacctgtaatctcccccctaatctcttctatgatcttaaatttgcatcatgcttgacatcatgaggaacattgttgctcagaaacatatcctttgtcctttaataggcagtgctagctaatcagtctggttgctgaatgaatgatccatcttctgtagggccatgttttaagcctgtgttagtcagctcaagatgccgtaacaaaatgtagactgggtggtttgaacaacagaaatctatttcctcacagtccttgaggcagaaagcccaagatggatgtcagcacagttgggttctggtgaggccctcttcttggcttccagacagccaccttctcaatgtgtgctcacatggccttttgttagcatctatgttagcagagagaccaagagcaagctctctggtgtcttttactataagggtactaatgtcatcagactaagctctgcccttatcacctaatctcctcccaaacaccccctctccaaatatcattacactggggggttaggccttcagcatatgaatttgagtgggaacacattcagtccataacaaagcctaaacagtactgagcctttaataatcagatatgatctctcttaagtttcatactagttaatgaattccagttagactaacttttgttccattagtagtagtgctttaaacctctatgtgaagtaactcattaaccaattccaagtcctaaatttcccatacccattatgaatgcgctataagttataaacattctccaggttaccagttttaaatagcaattgtgaaagactaatgcaagtataaaaacactttgtgaggctgggtgtggtggctcatgcctgtaatcccggcactttgggagaccaaggcaggcagatcacgaagtcaggagatcgagaccatcctggccaacacggtgaaaccccgtctctactaaaaaaatacaaaaattagctaggcatggtggtgcgcgcctgtggtcccagctgctcgggaggctgaggcaggagaatcgcttgaacccgggaggtggaggttgcagtgagccgagattgtgccactggactctagcctggtgacagagcgagattccatctcaaaaaaaaaaaaaaaaaaaaaaaa

SEQ ID NO: 2609 - DNA, 1434 bp, Homo sapiens
gctttgtcacacaatgtaatcttgtaatcctctgtccatctgtggccggcctgcttctctaaacgggaagactactgcttcatgctgctctattgcttgttgcctaccatctctgcctcatggtctgtcagtcattattgctcctagaccagctaagttgccccagtgtctcatttctgggtcttctgtgtgggctgttggtctgtaagcatctgtcagtatctaagcctgctgtgaggtcatccctcacaattacagaatacacttggtatacaaaaacacatgtagaggaaaagaaaattactgaagttccaaaaaacacctacaattggaccaagaattggcttatttttttttttaaagaaagagcagcttctgtatattatttacaaaggtcatcatttcattgattgcactggacagactaataattttttacccataaaattgtttagggttagtaccctgttaggacctttttgaacgtaaagaaggttttactttccatttaagacaccaggtttgaggtcaaaagataaacataagcccagagaagcaagcaattctatttcttctcatccctgttgctgagattgctgtaggtgaaatattaagtatccctggacagggcagaagtatgtaggataggaggcttgtgtgtagtgaggcttttatgaataaatcagtgaaatctgacacagaagccagggctcttcccctgatcaaatcaacaagatggccttaagtgctccgtcaactgtggacactgtggggagaggctgatcagttggatttggagccagagataagagtcaggagggccttgktcctctttacaaaggaattgacatgactaaattgaggaagtctcaccctaaggtgagatgccaaggaagatggcttgctgkcttactgtgkacccacatycaccatttcttataacttcaacccactatctagcatttgactggtctctcaaaggaactgaggcttttttawttctattataattgatagkcctattttacctagtcataaaataagtcctcaaaatatactggtwtgaawtagkaaacaaaataaaagttgtgttgacattttagatcctatttccaaaaaaagtaccattttattgkagwatgkggktatttaaaaccttaatttattgtcatttttagccaatacactattttatcaaaaagaggcagattgcagtagaagaatgaggaaaatgaaataccattcaggatttaggctgtgtcctatgctgcttctcctacacctctggacctctggtacacacacacactctctctctctctctgctataaaatgaggctcgcttttcaaaatgattatactgaaatttcagatgtcaatgaaatataattatgagtgtttgtgtatacttatgtatgtgtgtttccagagtag

SEQ ID NO: 2610 - DNA, 1710 bp, Homo sapiens
  misc_feature (1705)..(1705): n equals a,t,g, or c
gatttatgcatatggtttattatgcacacagtctagatttatggttgacttcaattatttttctattagaggagatctgagtagcataatattttggagaaaatatgaaatgaaattttttcttgtgaaagatatagtgtatattagctttatttctgactaacctatggataactataatcaaacatgtatcaagtagtaccactgaagaagtgtttgagcttactgggaacacttatgactcagcctattaccctggcataattattaataaagagctttttgtccttcttagaagtgagccatttggggtaacaccttacactgtcatactatgtttaggtaattaatttgttcttctgaataaactctcaactcctttcttacacccaattttacacaaatttagttttaattactgctttaagagctctctgaaaccaggaattcatttctgaggcatagtaaatcctgagaccaccatgctcacacagtgctatcatgtactgtatgaactttgtaaaatagagcttaatcttattttataatttaagatgattcagtgattaccttggtccatgtcattcacctggtaagtggtgtctgcattatttaactattttaamcattcattcatttgtgaaatgttgggtaccaatgatactcatgtactgcagttgcagagatgaatamcatgtaatctaggaactcaaaaagtttagcatcattgtgtgggtgacatatgatttgaattaaagcttctgtttctttatctagcattcttaccaccatacacatcgcttctttaacttatttcaaattamcmcamcaaatactaagaattttattagctgtggtgtacatcctaggtttatgaagtaaaatatactgtttcttttctcccacggtgtattattttttatatcagaatgcatgaccctgtagtatttttgtagcacatttactagaactataaggtattatatttaatgtatatgtttttaccatatttataagctatctctttctacacaattttaacatgtgctctcacacacgtacacatctgcattttatcttccataagagaagtactgattatatatgaataataatatacaaaagtaatcataattaccacataaatgagcagtattagatttagtaataaaacattttgaattttttgttcgtaaataggtatggtactgatagtcacacatgtgtattattatctttaaacaaaaacctcttagaattcatgagatataatattttcaaattttatgttttcaagagagatatttgcctccaaaattcactcttatattgttgcgtttttaattttatcaagataaccagttgaatttaatgcatatatggtgccatttctttcagataaaattgttracatcgctttaaaaagattagaaatttgaggccaggcatggtggctcacacctgtaatcccagcactttgggaggccaaggtgggcagatcacttgaggttaggagttcgagagcagcctggccaacatggtaaaacctcgtctttactaaaaatacaaaaattaaccaagtgtgatggcacacgcttgtaatctcagctacttggaatgctgaggcagcacaatctcttgagcccaggaagtgaaggttgcagtgagccaagctccagtttgggtaacagagcaagacttcatntcgag

SEQ ID NO: 2611 - DNA, 2279 bp, Homo sapiens
  misc_feature (194)..(194): n equals a,t,g, or c
  misc_feature (409)..(409): n equals a,t,g, or c
  misc_feature (413)..(413): n equals a,t,g, or c
  misc_feature (2263)..(2263): n equals a,t,g, or c
acacgcagctgtacccagcctcggggcgcctttgctgatggccacgtgctagagctgctcgtrgggtaccgctttgtcactgccatcttcgtgctgccccacgagaagttccacttcctgcgcgtctacaaccagctgcgggcctcgctgcaggacctgaagactgtggtcatcgccaagacccccgggacggnaggcagcccccagggctcctttgcggatggccagcctgccgagcgcagggccagcaatgaccagcgtccccaggaggtcccagcagaggctctggccccggccccagyggaagtcccagctccagcccctgcagcagcctcagcctcaggcccagcgaagactccggccccagcagaggcctcaacttcagctttggtcccagaggagacgccantggnaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaaaaaaaaaaaaaaaaaaattnctgcggccgtcaaggg

SEQ ID NO: 2612 - DNA, 708 bp, Homo sapiens
gaattcggcacgagccctgcgggtggtcccgggcctggccagggctcagtgctcctcttccccctcctccctgttcccacccctcatgaagcacactgcgtgtccatcccatgtacccgtgggtcgacgcacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggactggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcgggaaaaaaaaaaaaaaaaaaaaaaaaaaaaaaaaaaaaaaaaaaaaaaaaaaaaaaaaaaaaa

SEQ ID NO: 2613 - DNA, 1297 bp, Homo sapiens
acgcgtccgttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggtcgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatctttttttgttaactgatttgcaataaaaatgatactgatggtgaaaaaaaaaaaaaaaaaaaaaaaa

SEQ ID NO: 2614 - DNA, 1434 bp, Homo sapiens
gaattcggcacgagggggcgggggggacgagagtagtatctttggttctttggccctgacgctgtgttcctcttctcccagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccaktttaatgggtctggctcagggaagtgggaargtggtcccagcaagaattctgtctacatctcctcgttgtatttcacaatgaccagcctcaccagtgtgggctttgggaacatcgccccatccacagacattgagaagatctttgcagtggccatcatgatgattggctgtaagtatgacagtgctggggtggggttggccatctcttctgttagctggaaacagggaaatggctacagtgccagcaggatcaggagaataataacttaaaacaaggaagagtttttttaagactaggcttacagttaccctgataattaaagcagtatatgcttactgcaaaaaaatttagaaaatacaaaagagtgcaaagtagaaagtaaagactatccataattctgcttttcagagataactactaatactgttggtgtcttctcttacagactattttctttgcatatctgaatacatatagatttttataaacttaaaatgagatcttgctgcatacgcactttagtaaactactcatagaacagtgaattatggaagtcttttcatgtcaatttttttctttttaataaaaattgtatatatttaaagtatgaaatgagattttgatatagtgaaatgattatgacagcaaagcaaattaacatatccattcctttacatcattaccttttttttggtgaaagcacttgaaatctgctctctcagcaaatttcctgtaggcattacagtattattaactatagccgtcatgctacatgtcctacatgtcaatttgaacatagctgtagcttggcatatagtctaatgtagtatgagaaaaagaatgtatgaaaaatgaatgcaaaacatctcattaattgtattttatattgattatatattgaaatggtaatatttctgatgtatcggttaagtaaaatattctcttagaattaatttaatctgtttcattttccttttaaaagtagctcctaggaaaaatttaaatttaatcatttggacggtgctggtctagataaacatttttgatgtcttgctwgatgggaaattttccaactcaaaaaaaaaactcga

SEQ ID NO: 2615 - DNA, 1501 bp, Homo sapiens
  misc_feature (795)..(796): n equals a,t,g, or c
  misc_feature (823)..(823): n equals a,t,g, or c
gactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactnnaaatacaaaaagtagccagccgtgatnacaggcacctgtaatcccagctactcgggaggctgaggcatgagaattgcttgagcccgggaggcggaggttgcggtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggtttcatggtctctgaagtcactgactgctatttcagcttgtttacccttacctagcattaagactccatctacttctgtacagtatatgaaaatttttaaactttcatttagactggtgggatagggctgaccattacaaattgtcgt

SEQ ID NO: 2616 - DNA, 4416 bp, Homo sapiens
gaattcggcacgagggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaaggsattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttgrttactgtaataatgtcttgtttttagccatgtaactacaaacagatattctcttgatgtcttagtaaatttgcatttgatatatcattgatgagattttgttgttatgtaatattctttgstacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccaaaaaaaaaaaaaaaaa

SEQ ID NO: 2617 - DNA, 1287 bp, Homo sapiens
  misc_feature (1287)..(1287): n equals a,t,g, or c
ggcacgaggcamgatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagcactggcttttctcagcatttgctgctgggcctctcctgggactaccagtgtggctcttacgtgttttctttgctaaaataaaccctagttcttawaaaaaaaaaaaaaaaaggcggccn

SEQ ID NO: 2618 - DNA, 1544 bp, Homo sapiens
  misc_feature (1534)..(1534): n equals a,t,g, or c
ggcacgacggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaagcttctctaggccctggctgctacaaggccatgtccggacccacactggcgagaacccttctcctgtccccactgcagccgtgccttcgctgaacgctccaacctgcgggccacctccagacccactcagatgtcaagaagtaccaatgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagagccttcccgtggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaaccccactccctcacaaaccccccccacaagaacctcaggccaccctccacgaggtgtgactaactatgcaataatccaccccccaggtgcagccccagggctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaaaaaaaaaaaaaaaaaanaaaaaaaaaa

SEQ ID NO: 2619 - DNA, 1225 bp, Homo sapiens
ggcacgagcccgcggcccggctgacggggaagggctcagcaccccgggcacaaagctaggaagggtgggacacagtgaaggtgggaggaggagggggctgggggcaaccaggcgccgtggagctgccgctcgctgccccgggcaggggcacaggcttcatccagtgaatactagagggatcgaacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggt

SEQ ID NO: 2620 - DNA, 1913 bp, Homo sapiens
ggcacgagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaataagccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaatgtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattaaaaaaaaaaaaaaaaaa

SEQ ID NO: 2621 - DNA, 2192 bp, Homo sapiens
ggcacgaggcaatttgaaggaatttcttttttcataaatttatttactaagaaataacactgaaatttcttctatgggcctggttagcaattttgtaatatttcttgtgtttgtgagtgactttctctttaaaaacaaagtcttatctgagtgttttgatttcccagtaactacaaagtttttgtaagacagttttgagttattttccctcaaatgcaatattgtgttgcatatattttaacaagtataaagatgtggataaaattgataccttttagaaaataaaggaaaacattgtcttttctttgtgattctgtttaacttctcagcattaagtgaaagataaaaatttgagtgatccttttcaatattttccacagggaagagacttccaccttaggatagtgttgcctgaagatttacaactgaagaatgcaaggtgatatggtgtttagttataaacgtgcatttttgcattttggtgggacaggcagtacatttggtataaattgattctagtgactagagttttgcctaaaatgcttattagtcatttgccccaaaagaaacatttctgatttttccaaaccaatgcagcatttgtaaatatttacctgttactaaagtgcttttaaacattagttctctcatttttaaaaaaatatttaaagcagtaaacagccattgtgtacacttcactaacaaatactgaacaggtatataaagggagaacaaaaggattagaaaactttttttccaacttttgactgatattattaatgtgtatattcattatatgagaagagtcacatcagttcagtcctggcttaaattaggtaccaacattgagtgctggtagatacaactagtcaggatatgagactgaaaatttaggtaccaccccaaatctcaattctgcctctaaatatttctggagaagaatggaggaaaaggaatccagagatatttatgagtagaattgagaggattttgtgaccaacagaagtgtagttaagagggaaaaaggaatagaggatgcttttcaaattcccggctcagatctctaagctagagaagaggtcacagatggaaaagtagaagagagattgttttaaggcatatttggtgtgaaataccaagaggagctatttagtaggtagtaatgtagtggtgtggaaatagagtgtgagacctggagtgcagatgtgtgtggaagttacaacagatgaaggatttgagaccttgattatgaatagactttttggtgctgtgtctagcggggtagaagagaaagccagtgacaagaccttggggcgtaccaacatttaaaggactggtcactaaagaggaacttacaaggagactaaggattgaccagagaagaggaaaacttgggcagcagagtctttcaagccaaataaagagaggcttaagcaaggcatggttagcaatgctgaggattacaaagagataggttagatgcaagtaagttttgtgtggtggcagaagccatttgtgttggatgagtgggaggaaagtataaagtattttgaagaaaaagaggtggttagagaatggtatgcattcaagaaggagttatgatgttctttaaagatatatatttgagcaagttaattcattaaggagaaaaaaactagcagaacataaattaaggataccacaataaagggataattaattgaagtcaccaagttggtagcaggggagagaaagcacattttgagcaggggttaccaatggacatttgaatgaactactctgccactaagagaggagatagggatggttatggggatttgaagaccaagaatggagagagttgtgacagtttgaaaaggccatgttggggaaaactcagagaggcttcctacttgtaggtaactaaaagtaattccttagaagagttacttaatagtatcgggagcacaacagaggtcagccagtaagtggatgaacattaacttatcacttcttatacaattaattagaagtatgtatctttctagccaggcttggtggtgggtgtctgtagtcccagctacttgagaggctgaggcgggagggtttcttgagcctaggagttcaggttgcagtcagctattctactgcactccagccagcctgagtgacagagcgagatcctgtctctaaaaaaaaaaaaaaaaaaaaaa

SEQ ID NO: 2622 - DNA, 1385 bp, Homo sapiens
  misc_feature (1347)..(1347): n equals a,t,g, or c
  misc_feature (1353)..(1353): n equals a,t,g, or c
acaaaagctggagctccaccgcggtggcggccgctctagaactagtggatcccccgggctgcaggaattcggcacgagtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcaccgtggaccagagttaccgctcgcggctgcagttctccacaccgaargaggaggtgggcgccaacaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgcctcctgcttttggccaatcacggcagacaggggttggggaaatattttattaccaatgtatactgtgacagtttgtagccaaaaactgcggctggaggggtggggacgggacactgagtggtcacaagggacttgggctcacagcacaggggggacaaggggctggagagggtggcctttaaaagacaactgtggttatagaatgagctctctgtcctgtccccaatacccaagaacaccggtcacccaggatgccagggcccaagagcttctgtgagcccagctgtgacctccagaccttcctgagaccctctggcctttctgtgactctctctcagctgagcccccagggtacttcctgtagctgtctttggcctctctgggaatctcaaacctgtgactcagtgggagaggggatggggctggaaccaggcgggtgggagataggaactggggaaggaccaccaacagcatgcaagagacgccccgkccacggggccaagcctgcgtggagangcttanactcgttctacctcacgtgctgcccgagacct

SEQ ID NO: 2623 - DNA, 556 bp, Homo sapiens
cagccaccatgcctgcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgctttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtggttttaaaaaaaag

SEQ ID NO: 2624 - DNA, 789 bp, Homo sapiens
ggcacgagaggacatgtcgctttgcaggaaacaatctggttaagccagaggacccggccatttattggtgggttctggcgctttcaagaatgtgaagaatgagtggccaaagttaacaaaggagcatgcacagggatgggggtcacacccactttgtagagtttaagaatagtaagggacctacgggaacttctcaaggtaataggtggcatgtcttctttccttggcatgacacagaatgtaaagataatgggaggatgaacctccaagcctggaactttgggagaagcttctcctcttggaagtgccagtagcagaaaagttcccaaatagaacagattccttcattccacctgaattcagagagagatccatgtggacacatgtgcctctccatcagagactgctatccagacattcatcttccacctaaaaatgcacttctgctgttgactgcaggccaatgttcccaggataaacagggtgacatccaactgttacttgcctcaacttgcctttggggatcaagaaggaagttcccccgggtgggtggtagaactggaagtagtgtcacaggccatgggctcttttgcatttctcttactgtctctcacttggcctgaatgatttatcacacgatcagttgcaactgccaaagtttgggagcactacattgatgtgaagttctggagacaaaaaggaacacaaacagataaaggtagagaagacaaaagggtgaaagagagggctaacgactgggagaaagagagcagaaaaaaaaaaaaaaaa

SEQ ID NO: 2625 - DNA, 1691 bp, Homo sapiens
ggcacgagcaggcctccaagaaccatgtccccttcagagaggattcctaagcttcctcctcttcctcctcttcttactgcaagggaaatacaagatcagtctggaatgggcttccagattcatacaacctcccccaggacacagattccgagagagagaagaggaaggcaggtttggagcctccaccaccaccagtttccctcacgccctcctctctcccttcccctctttctcaacttcctcctttccctctcttccttctatgatctgtccctgcccctctgtctcctcttcctttccttccttcctcccttttctcctcccttccttagcaggcagcaatgagcaggtggcactgaacttagattccaccatcacaggtgggtagatcttggctcacaagcctgtcattgactagctaagtagccctgattggaggagtcattttatttccctgagcctttgtttctcatctgcaacatggagattttactcaccaccgtggtgcagacaaagtaggacaaagtatcctttaacccagggcttgacacgtgacactcatcaaacattgctgagctctaatctgcatcaggatatggtaagtgtctactgggtgctgggacaaaaggtacagatgggagcaaggcagagatccctaaacagacctctgttggatctttgtgaatacatggtaattatttgtttccaaaaagaggtggaaggagacataaatagcttctaccgccaggcattcaggcaccagctgtgaagccttctgcacattgaaaaactcagagtagcctggtggctggaatgaaaagtcaacaccagttcccccagcaaaatatttctccattcagccttttcggctcattggtttgcctgaaatcagttgtttctccctggggaagcaatctttaaaatggtgaggagagtgtgcatctgatgtgcctgcacttgtgcctgtggaacagggtaggctcagagctccgtgcaggcccatgaagtcccctcagagacaccagtgttgggttgtcatagggtcccagaaaatgcctgtctgcttcgtgagatttaggctgggtgcacagaggtttcacttggtgtgcctgacttatttaggggctgcctgatgttaaagaatcaccacacaaatagacaaacagacattggagcagaagacagggaacagaaagacgctcatatgtatctggataacattgacaggaaaatcaaattgtaatgtcacatacaggagtcttcatgaaggtaagatgtttaaaaacatttttaaaagtataaaacattgtttagaaatatacgcctttgtagtaaatgtgtaaaaacacgcattagaatgatgaacaccaaattccagagaaagggaatggatccctgtggggcacagagtgtgcattaactatgtttatgtctttaaaggaagaaaatatttgaagcagatatggcaaacggagaagattcatgaaagctggatggccggcgcatgagcgtttgcggtgtcatactttgtttccttatgtttgaaatattagcatggctgggcatggtgctcacgcctgtgatcctagcattttgggaggctgaagctgggggaacacttgaggtcaggagttcaagactagcctgggcaacatagtgagacctcatctccaaaaaaaaaaaaaaaaaaa

SEQ ID NO: 2626 - DNA, 2148 bp, Homo sapiens
ggcacgagtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggattactggcatgagccactgcaccagcctcttaaagcgcctttaatcaataggttccctgcctcttttcttgtttatcccccctacctcttttttatttgtggaggagactagtcatttgttccccggagcttcccacatgctggattttgctgactgccttcctgtggcaatctgcgtcttcatccccagaatttccaggacacttgtagttaggtctagaagctggacttgattcaggcttaatattttttagtaagtatacttgatagcaggtggtgtacacatccatcaggaggcacacaatgttcagttgtctctcttttatgacacaaacagtcactgatgatcattaactggatctattctttcaataacggtttgtaaaatggtaaaattctatcattccctcttcatctataagctggtatattgattaccttttactctgacctctggctctgcctcccaggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatggtaagcagcatcggtctccactgtcaccctcaggagaagtaaaggagaattctagttcatgagcctgagtttacagtcaccgcctgtccccaggagaatatcggtattttcagaactgccaaatctaagactttgggttcatttttgacctgaccagaatgtattttctggattcagacaggtagtagacaccctcaaacagccataaattctaaaatctttgccattgtcatgagataataaaaaagaggcaggaggagtcaccaggtgtcagtggatcttgtttctggctcccatgtctttgacagtaagactggtgacccagcagtggttatatgcactgactcaggagacagagggcctgggttctaatcctggctctgcctcttaatgacagtgtgactatacactattttggtctcatgtgcctacttgtaaactaaggatgatatattcttaggctcatggagctgttaggattaaatatgataatatgtgtcaccatacttaacgcagtacctgcccagtatgccacatcagctcaacgctgatgaaaacgatggtgatgtaattgctctgtgtctgtttcctcctcatctataaaagaggtgtaatatttctattagaatgaaatgaagcagtactttaaagtcactttgatgcccatccactgtagactggataaagaaaagtggtacctatacaccatggaataccatgcagccataaaaaagaacaagatcatatcttttgcaggaacatggatggaaccagaggtcattatccaaagcaaactaacacaggaatggaaaaccaaataccacatgttctcaattttaagtgagagctaaatactgagaacacatggacagaaaaaggggaacaacagacacggagtgtacttgagacagaggagggtggaaggagggagaagttcagggaagaaaaactgctaggtaccatgcttactacccaggtgacaaaataatctgtacactaaacccctgagtcacgagtttacctatgtaacaaacctgcacatgtgcccctgaacctaaaataaaagttgatttaaaaaaaaaaaaaaaaaa

SEQ ID NO: 2627 - DNA, 1111 bp, Homo sapiens
ggcacgagatcatgttttggttggagataagaaccagggatggcaagtaccagtgtgtacaaatgtatttcacggagtttgaaggaacgcataatcaagagggaaaacaatttgtccttcattggacgtattatttggatttgggtgagcaacaaaatggaatgtggtctgttaggagcattctgtttgttcttttgtccctgatgtgatgaatcattgccacatgctagatggactcttcatatccaggttttgtccctcagggctgagcactgtattaaagagtttttgttgagtcatttaaccttagtgtccacatccagatcagctgtaaaatggggaagacgtgtgctgatttggaatgaatgcaaaatatcactatcattttcctaattacagaggagcaaaggttatcttcagccctttcagttctatgctcacatattcaaatatcaaatgtaatttagctgaagttatttaataatcaagtctttcaatatctgttcaaagaaaaagaacacactttgaaaattctgcaaagctgtctcccagtctttaaaatgtctggaagcactctccttctttacaataccaacatcactggcccagaatcttccctgtgctaggttgtaaatataaataaattacttgttttgtaaacttttgtaaagaatattttggtagaaatacttcaaacatattctttgggttatatttatacatatgtgaaataaatatactatcaaaaggttatattttatacaaaaagtaaattgctaccttttgtatgctaatatgcaaagttttgtataatatgatggtttatttttagctctacacttaaaccataggtggttgagtgggaacttttgaaaactatcaagaggcttgttagacaaatttatattctgaaacctcaataagaaagcattccaggtttcaatccttgttttttgtcctgctcccaaattcttttttaaacccatagttcttgtgtcttatttgattcttctgctgtgcacattgtattggtccttgttgcatgtagtctactgtgtgttttccgattttataaggcagcatttctccatacaaaaaaaaaaaaaaaaaa

SEQ ID NO: 2628 - DNA, 2150 bp, Homo sapiens
gcggacgcgtgggtcgacccacgcgtccggtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaaaaaaaaaaaaaaaaaaaaaaaaaa

SEQ ID NO: 2629 - DNA, 2238 bp, Homo sapiens
ggcacgagccggcwckagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaaaaaaaaaaaaaaaaaaaaaaaaaa

SEQ ID NO: 2630 - DNA, 1750 bp, Homo sapiens
gcttagccctcacttctaagagtctgtaagatattcccacttgaggagcttgtcttcttcaatgctgtatctcagaaattaaactcctccttttctcacgccaaaccatctctcctcctggcttctctcctcttcatggggttgttcatctcccacacactcaggtcagaaaccttgctattgcctcccctctttccacgcccccacttttttctgctcatatcttgcccatcactcaatcctgcagattctttcttcatgcctttcattccttccttcccgtttctatggcccctactctgacccaaatcatattacctaatattgcttcatatttttacccaagagcttcgtcctatctctggttcccttggaagctccccaatgcctgcaggcaaatccagcccccttaaatttaccattcagtgcctcccataatccaacttgatctgctcttctaactaaactttccccatacccaaatgaagccccagccagcctggtgtgctccccagtctctggcaagcctctgctcaagtcctgtgttctgtttggaatgccagccccatgcacttcaccagtcctacttactcctttaaggctcagtcggtgacccacccttttggaggacatctgagctccccatggcagcttctgggcttctttgcatcctgggatctcccagaatctatttttcaacctgatgctacattcctccacagcagggagatgccttttattttgttcttcttccttataccgtcaaattccaaggatagaaaattgcatttccctgggcctgtgaaaagggatccctccctccctgcacactcatgcctggctcacacggagtgaaccagacagcgcttcctcattccccgcagtgggtgtcgcaacagccagttgcaactagaataggggccacatcccgagtctcttgaattcttgccctgtggttaggatgcccttcttgcctgtcctgaaggtggagatttcctacagccgagagagagggagtcagcagtctagggcaggaactccatcatttctttattaaaccactcctaactctctctaatctctgtgagtcttgcctttcccttttctctcctcctcctactgttgagtacaactaggccaggctgaatgagaggagaaagatggggaggaggaaagaagttaggcagccttggcagagggtgcaatgctccgggaaaatgggagagatttacaaggcagagattgacagtttttagtaacttgactttgacctccagtgtacacagacatagccttggctgctggactctgagctttctggccctgggaagctcgagatttgcaaacacttgttcgacaatcacctcgtttatctgcattgtcaccagtgcagcctctgagccctctccctgtctttacttgaccctgtatagaaaaatgctttcagggccaattgcagtgactcatgcctgtaatcccagcactctgggaggccaaggcgggcagatcacctgaagttgggagtttgagaccagcctgaccaacatggagaaaccccatctgtactaaaaataaaaaattagccggatattgtggcgcaggcctgtaatcccagctaccagggaagctgaggcaggagaatggcttgaacccagtaggcggaggttgcagtgagccaagatcatgccattacactccagcctagctgggcaaaagagcaaaacactgtctcaaaaaaaaaaaaaaaaaa

SEQ ID NO: 2631 - DNA, 979 bp, Homo sapiens
ggcacgagctcccgtggagcactcaggaaacgctccttcacccctcaattctgctctcacacaccccgtcacacatagactcacatacaccaagcagagaggagcaaagagaaggaccatgtaagacaatcacggacatggcgttagaaggaaactgagaaacgctctacaagagttcgatgtattacattatttttaatttagatgaaattcacataacacaaaatttaccattttaaagtgtacgtacacttcagtggcttttcatatattcacagtgttgtgcaaccactacccctatctagttcaaaaatattttcagttctcccctcctccagcatctgggaagcatccattcaccttccagctctgtggctttgcaggttctagacatttcatgtaaatgcagtcatataatatgtggctttttgtgtctggcttttttcatttagcataatgttttcaaggtttatccatgttgtaacatgtattcttttaaaaaaaattttaatgtgtaaaatatacatatcataacatttaccttttaatcattcataagtacacaaatcagtggcatgaggtggtcccttcccaatgttgtgctgtcatcaccactgtctgttttcagaactttgtcatcatcatccccaacagaaaccctgtacccattaaacagtaactcccggccagacgcggtgctcacgcctgtaatcccagtaattccagcactttgggaggccgaggtgggcggatcacaaggtcaggagatcgagcccatcctggccaacacggtgaaaccccgtctctactaaaaatacaaaaaattagccgggcatggtggcgcacgcctgtagtcccagctactcgggaggctgaggcaggagaattgcttgaacccaagaagtggagattgcagtgagccaagatcacgccactgcactccaacctgggtgacagagtaagactgtccaaaaaaaaa

SEQ ID NO: 2632 - DNA, 2367 bp, Homo sapiens
gtcgctgtcaggatcatgccctgtggcacagcacaggtggtgggaggtggttttctgactgagatgttgcctgatggatggaaagaartgtatttttaagttcaaaaagcattatcctgtggcattgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatg

SEQ ID NO: 2633 - DNA, 1092 bp, Homo sapiens
aaatttagccctggagctaatgggtaactctacattgaaattccactccatttcaagttcaggaaagtaaattgagtaatgsagagcaaatacaccgtccagagaggtgccgccaacccggagtgccagacagagagggtttcaggttacatttgctcaggacagagatggcacgtggccctttacatgaacaatcgttgttatattttattttgtgctgtttttaggccttttgaaaacatggagcctggtgtctgtttacagcagcctcatgtcagtggagtcaaagctcaatggccagctctgtgaaatttcaccaggrttttaattattttggstaactaccttgaaacttccaagcccttttatgacaattgacttaatttacatgaccactggcctggttgggaggcagtgttaagtgaaagacttcaacggtgcttctgtaaaatatattttccatcattcaaaaatgataaatggtaatttcagaacataagrtwagcaagrggwgcaaaaaaaagggggtatcaytaacaatatcttctgtggaaataacgtaaaacttaaattttgattyctgkttkgkattttcatatattttatagagagatatgkatatatattcttttagcctgtcacccaggctggagtgcactggwgtgatcatagctcactgcagactcctgagctcaagcgattctctctgcctcagcctcgcgaatagctgggactaccggcacccaccacacctggctaatttttttaaaaaaatttggcctggcacggtggctaaagcctgtaatcccagcactttgggaggccgaggcaggcggatcacgaggtcaggagttcgagaccagcctggccggcatggtgaaaccctgtctctactaaaaatacaaaaattggctgggcgtggtggtacgtgcctgtggtcccagctactggggaggctgaggcgggagggcaggagaatggcttgaacccaggaggcggaggttgcagtgagccgagatcgtgccactgcactccagcctgggtgacagagcaggacaccatctcaaaaaaaaaaaaaaaaaaaaactcgag

SEQ ID NO: 2634 - DNA, 954 bp, Homo sapiens
ggcacgagggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggctttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccatccttacaagccctggtcagtcaagtcccaataaatggtcagcacaaaaaaaaaaaaaaaaaaa

SEQ ID NO: 2635 - DNA, 541 bp, Homo sapiens
ggaattcggcacgagaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaa

SEQ ID NO: 2636 - DNA, 1142 bp, Homo sapiens
ggcacgagtcacaagctgccgctttagattctcccaaaaagtctccccgagggggctgaggagcccccgtagccctcggggcatctcagctggcagccccagcgtttccttccccatccctgtcctacagattcatgctggtcctggccagcaatctgcctgaacagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaaaatgcgctggctgaaagcggaggggcctgggcgcggggtcgacaccccctatccggagtccaaggcgagacctcacctcatggagcctggccacggacccctcctacccctgccttgccggcccctgcacatttaggatatgctcctggatggggactgggctgtgcccagggcctctgtcccccaggatgtcttgtggtggcggtcggcgttctgccccccagggcacccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcaaaaaaaaaaaaaaaaaaaaaa

SEQ ID NO: 2637 - DNA, 1452 bp, Homo sapiens
  misc_feature (1352)..(1352): n equals a,t,g, or c
  misc_feature (1399)..(1399): n equals a,t,g, or c
  misc_feature (1415)..(1415): n equals a,t,g, or c
  misc_feature (1426)..(1426): n equals a,t,g, or c
cattaagttttactgaccaaaaaggtggaaaaaagaacctaaattttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttgcatttgcttggcatttnatttcttccctcaatctgttgtaggtttacaaagggcaacgctgttncagttaattttgaggnccaaattgtcnttttttttttttgaggacggggtctt

SEQ ID NO: 2638 - DNA, 1452 bp, Homo sapiens; identical to SEQ ID NO: 2637
  misc_feature (1352)..(1352): n equals a,t,g, or c
  misc_feature (1399)..(1399): n equals a,t,g, or c
  misc_feature (1415)..(1415): n equals a,t,g, or c
  misc_feature (1426)..(1426): n equals a,t,g, or c

SEQ ID NO: 2639 - DNA, 1452 bp, Homo sapiens; identical to SEQ ID NO: 2637
  misc_feature (1352)..(1352): n equals a,t,g, or c
  misc_feature (1399)..(1399): n equals a,t,g, or c
  misc_feature (1415)..(1415): n equals a,t,g, or c
  misc_feature (1426)..(1426): n equals a,t,g, or c

SEQ ID NO: 2640 - DNA, 1452 bp, Homo sapiens; identical to SEQ ID NO: 2637
  misc_feature (1352)..(1352): n equals a,t,g, or c
  misc_feature (1399)..(1399): n equals a,t,g, or c
  misc_feature (1415)..(1415): n equals a,t,g, or c
  misc_feature (1426)..(1426): n equals a,t,g, or c

SEQ ID NO: 2641 - DNA, 1195 bp, Homo sapiens
ggcacgagcttacagtgtcagtgagttgtgttctctctgttcctctttagagataggctggaggcatgtatagcttggcttccataatgcagataaaaaaatatttttccctaagtgttttccttgccttagtgtcttcttgctgtttctgcctggacttggagagattacaactatcgaattgagaataccagaagcaacacaagttgtaacttagagacacagagcttacgtggctgcaaatactttgtagtgtaagcgctgacatacctcagttttggagccaaagagtcacttttggtcacttctagaggtgtgatcttaggcaatttgctcaacctctctatgcttcggtttcctcatctgaaagatgaagatcataaaagtaaccatcccacagggttatcatgagaatcaataaaagaatctatgtggagtgcattgcataggaccagctccacaatgctctatatttcattatgtcccctgcacttacaaaagatgacggactgttcggatggcacaaatacaaactatcacttccaggacttaggtccatggctctcaaccctaaagagcatttataaaactactaaggccttagccttacctcagaccagttaaattacaattactggagaacagggcctaggcctcaatatatttcttaagctccacaggtgattctcaagagcaaccaagattgagaactgctgatgcattggactctgttggttgtgtctttaggacctaatagcaatcatccagttgtgtgcttggtccgcaggggattctgctaagactgtcaggccatacagggtgtgggcctagttctgggagaatggttttcaatttgactcacacctggggctggtaaatcttcagtgggtgcatcacagagtagggcaacaaggctccctgagagttgagagaagggagtgggagcaaataggaggtaacccccctattccttaattttaaaaatgaaaaatcagagagctaagagtttggagttctaaggtaaagtccaaactggggcacatactcccacttgggtaaaaagaaggaaccaacctgcaaatcagaccaaaaccgcagatgcgcagctgggaaactagacacgaactcatcatatccaacactgaaagatagctcagatttctcttgcatggccttcaaagcaggagatggttct

SEQ ID NO: 2642 - DNA, 542 bp, Homo sapiens
gagattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgttctgtggatgacctaccctttcctttaaacacgattctctcacttccaactccaaacttgctcaactaatccttaaaaataaacttgagctggaatttgaaaaaaaaaaaaaaaaaaaaaaaaa

SEQ ID NO: 2643 - DNA, 549 bp, Homo sapiens
ggcacgagccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaaaaaaaaaaaaaaaaaaaaaaa

SEQ ID NO: 2644 - DNA, 1707 bp, Homo sapiens
ggcacgaggaccattctgtgaaagtagcagaatgtgaggagcacgcgtgagcttatgtaccgtgaagatgatcagaggatatcttattttaagagtaaaaacccacataattttatttctgcttgatagtcatggtagtctgtcatacccacctctgggactctgcgtggctgtttggctgtcacttgtagcaataacgacattagttctagtcagtgctgttttacatttttcttttgatgggtttagtcttgccctggagtgccgatgatgattctccctccagagccacgcttgggaacatgaagcaagtctggcgtgtgggctgcgtgccggccttagtgggacccgtggggttggagcatgcctttaggggcagtgtctgggccgaagcacgtcccaccacacagtgccagagccagagaaggggccccaccaccaaggccaagcttgaccaggtcagcattgccatggcccagtgtgccccgtggcctctgaagatccctctgtgcagggtctgcagggatctggattgcaagggcccaagtctgcaggtctggaagcatcttcctataagagcactttcgccttctgggtcaggactccaaggtgcagcgggcttcacagccctacaattgggttctcagctaagccccagagttctggtagaaccatcccggggcgggtggagggtgggatttaagggagacgggaacacatggggcaggtcctggaacttggtggcctgaggactgaggccattgccctggtggaaaggcctggcctggttcctgtggcttgggacctgaataggcaggtgctgctggctccgtagaaacccttttcccatcttttgctctttgccaaacctaccttgctttgggagctgcctgcaccaccccagagaaggccccaccttcttcatccctcagacccgaggaggcctcccagtaaggagtttcccaagaggggactcacaggaaacaagtcttagtgcttgggagggaggccccgctgcgtgctcagactcacagccaacctggaaggtagacgagatagcgccacccacgcccctccacaccccagactccgagtaaagcgggcggtagggccggagtcacctcccctatggcagtggccgccgctgtactccatcctcccgtcaggaagatcagctgtaaataaacgctgggctccccagagcacctgtccgcccactgcccttgctgttctgggatcttcgctgcagttcacgggaaacaagcctgagtccgctcgcacccgcggctgctctcccggctcggcccggccgcctctgtctccggccaccgggtggcgctgccgagccagagccgccgcgtcccggcgctttccaggagccccaggcccggaggaggcgaagcccgcagagcaaaggtggaaacacgtgcctacgctgtaaagaaatcctgttccagagcatacctgttgtacaaacagacactgttcctaacgagaggagtgacgtattttcatcaccgtttttaatttgttttcttacgggtttacgattttgaatttttcttatttggttgaaagaattttgattctatcagcctgagtgagttcagcctgtaaaaaggatgttaagctgtgggtaaaatatgcaaacgaaaagaaatatattgtacaaattctatataataaggtaaaaaaaaaaaaaaaaaa

SEQ ID NO: 2645 - DNA, 1159 bp, Homo sapiens
gtgctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaaaaaaaaaaaaaaaaaactcgag

SEQ ID NO: 2646 - DNA, 960 bp, Homo sapiens
ggttttccaaagacttccaactgttccagtcctctttttgatttttttctataatgtaaacaactaattcagagtctgtgaaaatttgccttgaaacccattaaaatgaatttattgtttccaaaaatattaattagacaagctctgaatatgaacaataccattgaatagcttctaaaagaatgagtattttcagatgttttaaattaccttttgtctttgaagctttccttattttccttgcgatatcctattttctcttttgtgacaaaaaaattagacaaacatgttgaaaattggttataattcctaccatcacatgctatttcagatagtgactaataaacacattacatcactgtaatgtctttcccatgtagtcctgactgttcttgatagaacagattcaccatccagatcttatctatgcattgatccctcaataaaggaataacccaagatgaagttggcagtgggtatacacacagctatgtcacaccaaacttgaaatactttttagaagttttaaatgctgataaacaaactcttaggacaaatcacwaatgagcatggaattcccatcttcttcagatttattcatcataaatggttttcacagattttatcataaaaacataatcttctctttcattcatagtttataattcacatgatttattcacattaaccagctgtgattggagaatcaggarrarctttgagtcccatattttataaatgcttctgagaagtaccatagttaatgcccctttcaaataaataattttggatggttgtggtggctcatacttgtaatcccagcactttgagaggccaaggcaggaggatcccatgggcccaggagggcaaggctgcagtgagccatgatcagagcactgcattccagcctgggcgacagagcaagagcctgtctcaaaaaaaaaaaaaaaaaaactcgag

SEQ ID NO: 2647 - DNA, 1065 bp, Homo sapiens
gcccacgcgtccgcccacgcgtccgcccacgcgtccgctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgatagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtcaaaaaaaaaaaaaaaaaaaaaaaaaaaaaa

SEQ ID NO: 2648 - DNA, 2631 bp, Homo sapiens
  misc_feature (2619)..(2619): n equals a,t,g, or c
ggcagagccacagtgatagaatacgtgaagccctcagacctcaaaaaggacatgaacgagaccttcagggagaagttcccccatgtcaaactgacgctgagcaaaatcaggagcttaaagcgkgagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtkctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctycgctggtgcagctttcctttttgcctctttgccatttccttggaaagagacgtcgctttcatccccaagtgcaccgtccctccgaggggatttctgagaattctcctgcatttttacataaactaaatgkgaggtttgttactggtatttttttcacgtgcctgagaccagcctggtaccaggaccttttgttcacagcgtgcagcagcgagccggctgcagtgygtctcccctggcctcgccttctgcaaaccaccgcagccaccacagcgtcagggtggagatctgggtttctagacctcactgaacacactgaaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacactkgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggytctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcarcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggttttttctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaaaaaaaaaaaaaaaaactcgagggggggcccggtacccaattcgccagagagtgncaatggcatcaa

SEQ ID NO: 2649 - DNA, 1879 bp, Homo sapiens
ggcacgaggtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgcgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaagaaaaaaaaaaaa

SEQ ID NO: 2650 - DNA, 1631 bp, Homo sapiens
ggtttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttccaaacccaattgaattattttggtttcttaaaatcttttcccgatagcccatttattttaatgttctgaatttccaagatctgtgtataggttcaatgattagtttttactgaagacttatctatggactgagtgtgtattataaaactagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcatttgtcacccaggcaggagtgcagtggtgccatctcggctcactccagcctcaaactccttggctcagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaaaaaaaaaaaaaaaaaa

SEQ ID NO: 2651 - DNA, 3382 bp, Homo sapiens
  misc_feature (18)..(18): n equals a,t,g, or c
  misc_feature (2320)..(2320): n equals a,t,g, or c
ggacaaaatgaagagttnccttgtacatgcccactatgtacctcagacagagggagctgtgttagtacaactgaagggatccaacttgcaaaagaactaggagcaacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccratttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggcmwtcctggtggccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggarcaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggaggnaagagaacatagtgaagattcccgcctttggggaggtctggaccacccagggcctccactgccaccttggctggcaagggagaaatgtgttgtgttgtcttagctttaaaacagtgcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaactcgta

SEQ ID NO: 2652 - DNA, 1408 bp, Homo sapiens
ggcacgagccctcgagtccactgttatttccttcactttcaataggctgtcattaaattctccttccccattatcagtgccactgcttcttctcttccatgttcacagtcttacttttagagctgtttagtcatcctacctatgctggtttctccatagcctttgaattctgtgtttgatacttttgaacagaacatctaaaagctccctttctgtattccaacactcatagggtgattctcattaagaaaacaaaaccaaaaattgagctcagactaaaggaattcttttttgactaaatagtgattaagttatgatattcctgttggcctaagaacaatgcctatgatttagttgtgttatgtatatttgtacttataaccaaacaatcgattgggtacaagtagccttagggcaatacttccttaaaaacatgtttctgataaactaaagctttagcattaaccagaagtcataatttaatagtattgtaaaaatacctcatttattttaaatcctgtgttgggtagaggattacagttgtcatttcaaatacatgaatctcttgtcaaaagagtactttgacagtttcatggtaagaccccttcatatactacctcaaggagtgagatttttattgtgcatgttgtttggatgtatggggttggagaggtaggttgagcctaaaatttcctaattactttactcttttacgtgtttcttattgcaaaggcaagaaattgttttcaagtttgtcattactaataacaaagagatctttttgttttttggcagtggtgaggatgagattgatggagttgctgctttagcttattggaggtgtggatcattttattttttgtgtttgaccggtcaagtgacttagtgagaagggggaagtagtagaacaaggagttccatctgtaactgtgaacagtcaattgtgataactcactacctttagaccagtcaataattattttaaagcctgggattatacaatatttgttaactatggtatcaatttgtaacttaaattcatctcaattctttgtcctaagcagctctcagtttcattttttttgtttgctgtagaagaaaatattaagccaggctgggcacggtgctcacgcctgtaatcccagcactttgggaggccgaggcaggcggatcacgaggtcaagagattgagaccatcctggccaacatggtgaaaaccggtctctactaaaatacaaaaattagttgggtgtggtggcgcacgcctgtagtcccagctactcgggaggctgaggcaggagagtggcgtgaacctgggaggcggaggttgcagtgagccgagatggcgccactgcactccagcctggcgacagagtgagactctgtctaaaaaaaaaaaaaaaaaaaa

SEQ ID NO: 2653 - DNA, 583 bp, Homo sapiens
cacgagcaggaactcaaatgcttccacatctccctctctctggttctcttttatgcctctcatgttccgtccgttcattctcttgctctacagattggcttcctccatctgatagtggaacatggttgtcaaaactcacaaatttcacatcttgcaacattcaccatcagtgaggtgtttacttactttgagtttgaaaaattgagggaaaggctctgagtggccttgcatgggttagatgcccatctctggaccaatcagctatggccaggggtacaatctttaagaatataggctgggcacggtggctcatgcctacaatcccaacactttgggaggctgaggtgggaggatcgcttgagttcaggagttcgagaccagcctggccaacataggaaaaccccgactctactaaaaacacacacacaaatgagctgggcatggtggtgcatgcctgtaggaggctgaggcaggagagtcacttgaacctgggaggcagaagttgtattgagctgagattgcaccactgtactccagcctggataacagagtgaaactccatctcaaaaaaaaaaaaaaaaaa

SEQ ID NO: 2654 - DNA, 570 bp, Homo sapiens
ggcacgagctgcacatctcggcagagcgggcgctgaccctaccggccatgatggggctggcggcggggggtgggctcctgctgctggccatcacagccgtgctggtggcctacaagcgcaagactcaggacgcggaccgtaccctcaagcgtctgcagctgcagatggacaacctggagtcccgtgtggccctggagtgcaaggaagcttttgcagagctgcagacggacatcaatgagctgactaaccacatggacgaggtgcagatccccttcctggactaccggacttacgccgtgcgcgtgctcttcccgggcatcgaggcccacccggtgctcaaggagctggatacgccacccaacgtggagaaggccctgcgcctcttcgggcagctgctgcacagccgcgcgttcgtgcttaccttcatccacacgctggaggcccagaagcagcttctccatgcgcgaccgcggcaccgtggcctcgctcaccatggtggccctgcagagccggctcgactatgccacggggctgctcaagcaactgctggccgacctcatcgagaagaac

SEQ ID NO: 2655 - DNA, 2369 bp, Homo sapiens
ggcacgagcttggaatagggcatggcacatggtgacctcccagggccttaagcagtgacagtggggagtgatatactcctatcctttctcgcccttctcaatgaagccagtttctctgattagcttgtcaatattgagcctttggggtatcttggttgcatttttagttacagagtgcgcttgcagaaccctctcttctccttggccgctggcagctgttctctgctctccctgcctctgtcgtgcttggcctcctcagcaagcctgttggctgtgggcgtccccagtactccgtctgcatgcacactccttggggagtctcagccacctgggttctggccccacctccaagctggtgaacctgggtctccacccagtggccaggtgccttctgccggacgcctttgcctgcctgtcccacactggctcctcctccaaggctccttgactgttggtggcagcaccatctgacctagagctggagtctttttccttggggagggggcgtcccttgcccttagtgatgttgatttctgccagtgggctgctgccgtcattcctgtcaccacaggttctgcatgggctttggctgacatcctcccctccagcctggccaatttcaccaggcccctccatgcttcttggaaattctcctttgctgcttgttttagctttaaggaaagccccgatgtctcaacctgaccatcagggttcctggtgactgtggtctctccttgtccacccacttccaatcataaaactggcttccccagctctggtgcaggcccttcaaattcatgggcagaggttgtaggcagacatgcattgcctttccctgcagtaagattttgaaccccatctgctttgaggctttggggttactgggcaaatatacccatccctgcctgtcagactgtacctaggaattttggagagcaaagaaaatccttgtttctttatggaaaaaggaattgatgtgagctgtgcttgggttgaagctgcttttatgtggagaatgcaggcttccgcaacacccaacatagcccaccctgcatcctgtttcccctcagcagccctcccttcagctccaggctacatggagccctctgcttgtttttaatttacaaacttacgtgatattcaccaggtaccaccttacacgttagctcacttgattctcatgaccaccctgtgaggtgggtactcttatccccattttacggatgaagaaactgaggcacaaggtggttaatatttggagttgccctctggctccagcatctgttctggcaccatgtgctttcctcttggccatgtccctcctgtgccttcttgaactggcccttaactctcatgtccacatgctcagccccagggctggggctctaagggagaggcccctggcagctgttcttctcttccaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccataaaaaaaaaaaaaaaaaa

SEQ ID NO: 2656 - DNA, 1936 bp, Homo sapiens
aacagaggaggcatacaatgacttcaggcaaagcagaaccttttgactcacacaacattatattattttgtcagctttatattttatgaaacatttttactatgagtgaggcaagagaaagaaaaaggaagagacagcatttggttatattacatcatttctaaaatctaatttcctggagtgagaatgacactaagggtacctacgagaacattccttcccatgtwaactaatagtgtaataaatactcatatagttactagttttagttgccaaacctagtttgtaaatggtaaatttgagaccagaactatattcttatgactatcagaccactgatagtttcactaagtcaactcccttcactaacaatttgattctacacacacacacacacacacacacacaccagtttcaacaattttctcataagctttaaatcaaattgatgagagaactttccctgtttttctgtcataaactacattatctgataaagttcatactatttttacatacatagattatttaacatactttgcctctcttgctgcagagaactttgcttaagatatacagctgatctattctaatttcatgattatctatttatatttatttgttgttattgttgcttgaacactagttttcgagcagttttagagatgataccacttttacactgtttttctctctaattttagttccttatggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaacttttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgkttttttgtagagatgaggtcttattatattgkccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaattaaaaaaaaaaaaaaaaaaaaaaaaaaaaaaaaaaaaaaactcgaagagaactagtctcgag

SEQ ID NO: 2657 - DNA, 1879 bp, Homo sapiens
ggcacgagcagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttaaaaaaaaaaaaaaaaaaaaaaa

SEQ ID NO: 2658 - DNA, 1089 bp, Homo sapiens
  misc_feature (3)..(3): n equals a,t,g, or c
  misc_feature (8)..(8): n equals a,t,g, or c
  misc_feature (585)..(585): n equals a,t,g, or c
  misc_feature (1071)..(1071): n equals a,t,g, or c
  misc_feature (1075)..(1075): n equals a,t,g, or c
  misc_feature (1079)..(1080): n equals a,t,g, or c
  misc_feature (1086)..(1086): n equals a,t,g, or c
tangtggntccccaggggtgcaggaattsggcacgagctttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggttcctgaaggtgcccatctggtggtaccagcttcagggtccctcaggacactgggagagtcatcaggaccagaccaactgtacttcgtcttggggcagaktttggagagccayttccagccaagktgcttctgggaacgagcctgcgcaagtttctctcctctacttggggagacatagagatctcagaagatgccacgctggcggantgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaaaaaaaaaaaaaaactcgaggggggcccggacccaattcgccctatagtgagcngatncaanngcgccnatt

SEQ ID NO: 2659 - DNA, 2957 bp, Homo sapiens
tgggaccgctgtgtagtagggggctacctctctccaaagacagtcgcagatacatttgagaaggtagtggctggctccatcaattggccagccatagggtccctcttggactatgtgatmcgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaaatctktatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggwtcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccg

SEQ ID NO: 2660 - DNA, 1419 bp, Homo sapiens
ggcacgagctcgtgccgaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccagacagacgctctgtattcataaaaaaataacttcctacctgtctctccccctagtctttggtaacctttgttatactggtaaactttgttggctctgtgtctgtgtggaatttggcctattctagggcctcatataagtgtaatcatcagattgcttttgggtctgtctgattcactagcgggttttcaggttcattcatgtgcagcatatacagtactgcgtcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaaaaaa

SEQ ID NO: 2661 - DNA, 2043 bp, Homo sapiens
ggcacgagcagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccaaatgcaagccccctcttcgctgggctcccagcagtgcttccctcctccaccctccactcattttgttctttccccccaacttttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttcaaaaaaaaaaaaaaaaaaaaaaaaaaaaaaaaaaa

SEQ ID NO: 2662 - DNA, 1484 bp, Homo sapiens
ggcacgagaaaattttaaaatatctattgaattttattattttttgacatcccttggtcatggggtttctgtcgtaaatctgttatatggtgagctgctttactggagtggactcaacgtggttattgtatattgtcttttttgtattttttattgatatagttgtacatatttttaggatacacatggtattttgatatctgtatgcaaggtgtgatgaccaaatcaaggaatttgggatattcatcacctcaaacatttattttttgttgagaacattagaatctctagctcttttggaacatacgataaattatgctaactgtaatcttcctgctgtcaaatactagaacttattccttctaattgtatttttgtacccattaaccaacttctcctcatcctgccctgccttcccttctcagcttctgggaatcaccattgtaccctctacctccatgagatccatgtttttgactcccaccttggcctcccaaagtgctggaattatatgcgtgagtcaccacgcttggcccaaaaacaatctttttgaaaaaactggggtaaaattcacatgacaaaatttgccatcttaatcatttttaagtgtatagtttagtagcactaagtatattcacattgttgtgtaacagagatccaaaacttcctcattttgcaaatctgaaactctgtacttattaaacagcttccacagtccctggtaatcaatcaccattctaactttgtttctgtcaatttgtctatttttgatacctcatataagttggagtcaaatagtatttgttttgtgactggcttattttacttagcacagtgtcctcaaggttcatccatgttataacatgtgacaagattttcttcttttttaaggctgaataatattgcattgaatgtatatagcacattttatttatctgccagtggacatttgggtttgctttctcctcttggcaattgtaaatagtgctgatgtcaacatgagtgtgcaaacatctcctcaaaatcctgcttttaattcttttggatatatatccagaagtaggattcctggatcttgtggtagttctattttcaattgtttgaagaacctccatactgctttccatggtagttgcaccattttatggtctcacctcagctttttaaaacctgtttaattttgaatcctaaccaacctctggtaacagataccaaattacagctagataggaggactgagctctcttattctgcagccctgtagagtgaatgtggttaactgtatttattgtatattttcaaaaagctttctgaaagagaggattttgaatgtttacagcacaaagaaatgataaatgtttgagatgctggatatactaattatcctgatttgatcattgcacattgtatgcatatattgaaatatcactcagaatcccataaacatgtacaattgtcaactaaaaaaaaaaaaaaaaaaaaaa

SEQ ID NO: 2663 - DNA, 2865 bp, Homo sapiens
  misc_feature (1965)..(1965): n equals a,t,g, or c
  misc_feature (1971)..(1971): n equals a,t,g, or c
  misc_feature (1999)..(1999): n equals a,t,g, or c
ccaacagggaaattaccctcactaaagggaacaaaagctggagctccaccgcggtggcggccgctctagaactagtggatcccccgggctgcaggaattcggcacgagaaataagtgaatagaaactgttgctaatttgttcaccaggccttttccctgagaaatataaactgttgtcactttatgtccttattcatcacttcaaattgtttgttttcctgaacatttaccactaatatggaatttcaaaactgttgggttgaaagatcaatagaagagtatttgaaatgtattttgtgaaatcaaatgttggtacgtgatggacggacatatgcttattttaatagtttttaaaataatcaagtatttactaagtgccaggcacaagcctaggtgctatgaatacctgttggtgttcaggaactacatggtccttggtcctcgccctcatgaaacttatactcaagtaggaagtagacaagataatgtgaaatagtaacaaatgctgtgaatctaacacagtaataaaatagaatgtgtctagaactgggttctcttagtaaggatggtcagaggggttattaaagtaggtgacattttagctgagaccaggagtgataagaaggagccaaattgggtagaaaattgctttctgcaaaagcagtagaaagtacaaagaattttcaggcaagagtgagtaagggtttgtatgagtttggaaacgaattgtttgaagtgaaaagaagtaggcaagatgcatattgcataaggcatagggccatgttaaacaatatttggttacgctggatgtttctgttgcactctgaatggttagccatttcatgaactgaatttcagcaaggtgattgactttttaaaaaaaaatctttttcagatcaggtatttggatccaatctcgctaatctgtgtcagagagagaatggcacagtaccaaagtttgtgaagttatgtattgaacatgttgaaaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagtatgtgcaaaggctcttggcattttaaacaaaatgaaagtatatccattttgaaacctgtgtatttctttttcggggtttctgcatncagtgncagtcttaagtgccaaaattcattatanccccaaaataaccccttgatgaaggcttgctgtcttttactgtgttacacagcatccttactgatatcttagttgcttgtttgggcagcacactaatattacttaaaacactgtgatatactggagttttagttagcgaagtcagttcagggcattttaggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatggtccgttatttgggaaagttaactgtgtgcactttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaaaaaaaaaaaaaaaaaaaaaa

SEQ ID NO: 2664 - DNA, 1272 bp, Homo sapiens; identical to SEQ ID NO: 2051

SEQ ID NO: 2665 - DNA, 1529 bp, Homo sapiens
ggcacgagcaagccttcaactttcgcagagaaaatgctcaaaaacttcagtttcagcagtgcccagcaaagggcaagtgcggtcttcaaggaggagctgggagatgatgagcgatgggaggcaagcgtggggactggcgggaaggcgggagcagctgaggggatcccagtggacccaaactacaagttggggcttgcagggagcctctgctgaaggtagtaggaaatgtgcttcttactgctcccttgtcttctctaatactcctcttagttcttttcctcttgcataccttttatttctggctaagtgttgggcattgttgtacattttctagcttgactcccttgggcaagttactttctgtctctgtgcctttgtgtcttcatgtttaagatggaaagaactgcagtgttgacctcctagggctgttgttagaagccattgaagacacagagaatacttagaataatagttggaacttggcaggccctgagttaattcactgccatcattgtcctcgtgcttcatagcagtagccgtgttgctgctcttagcctcagttctttcatgggcttctttcggttccttggaggctcccaagcaaaggtttttcagcacctctgttctgtgaaaaagagattaagcattttcagtatatttaaagttatctccagcctattgtgatgatgccttttctccaaaacccttttttattttcgttttattgtaggcacaaatctttctaatgcagatgcttaatttttcccaaaaagcaacttactcctttcaacaaggttttctatttggtcatcacatctgcattcttccaagaagcccactggtaaataatggaacaatgaagcagtgtcgccactaaagagtaatctgcaaccacacagaagctggaatcccaagtacctgtcattatattctcctacacatgtgcagagtttgataaaaagagagagccagttttattattcctttaagaggaaaaaactgccaagaactcctaagctttaattaccaaaataagcttgccttaaacaaattcaaacacatgaacacaaagtagaagatcaaatgcattttgtggccccatgcacatatatcttccatgagcttgtatcttcaaggtaacagtgctgcgtctttaatacccattagcgctgcactgtctaaatggtgcacgccagaaaagagccgtctctaggtgtctcaatgaaccatgaaaatctcagggaaaatgtattaatatatttttcagcaaatcctttgagatgaggattctcaggaaggattttagtgcattatgcaatgtagttgaattccctcttcagtattgaatatgctttgctttattccaaagagctcaacctcttcctatagacattgaaattcatctgtttcattcatagcaccacgtaaactttttatttttgtctcaaacttctctgataagcttgcctctgcatacaaaaacatcaaagcctgtggtgaaaaattattagaaaaaaaaaaaaaaaaaa

SEQ ID NO: 2666 - DNA, 1314 bp, Homo sapiens
gcacactactgaatcttttccaatcaagctgtcactcccacccttcacctcccacacaaacaccccatcacactactctggtcaagttccagtgacctgcacattgccaaagccaatggtcaattcctagtactcatattactcaacctatgagcagtatttgttacagttccctccttctttaactttttccattggttttccaggactcagtactcttaatagctttcctcctaaatatccagtcgttctcagtctccttttctgcttccacctcttctttacaatttctaagcattagaatgcccccagggcttagtccttggactttatctatgcttactactttgctgacttcattcattccatttaaatactctgcctatacggatgtcttctaaatagcaatagaaataatctcagcctcctccctgattttgttggtccagatattactccttggatgccttattagcatctgagatttaacaggttcaaaatttwagctcccgatctctgccctaccctcacctcaatttactattttcactgtctttctcatgtcagtaaatggtaacttcatcttttagttaactggaccaaaactggcagagttatcctcagcccttctctttccctcctgtgctttatccaaactcttaggaatccagtcagctctatcttcaaaatatagctgctaccccatagtacttaatcatcattggatataaattccatgtaatcatcttgtttactacctgtgcaccacccacctcccctatccaccctccaggccccagcaacataagctctatgacaatatggagttccatcagtctcagccaatgtgtaggaagaggcagatgaataaymyygaaccaccattagcatggcacttctttacttcacttctttactcctaatacctagaacaatgtctagcacattgtatgttctcaataaatatttggtgggtggttagagggatgaatgcatgaaaggatgaaaggaacacatgaaaggaaggaacatcaaaggagctgagcttgagtcttccctttgccctttattacctgagtgactttaggcaagtcagttgattttcactgaacctttcgtcttatttagaaagttaggggataaaataggtcctattctgataaaataggtttgttctgagaatcagatgagagaataaacatatattttcttgataactagaaagtcgtatacaaatgttagtcatgataaggagggagaaaaggaagggaaagactcgagggggctaatggttgccaaatgagaggtctcgag

SEQ ID NO: 2667 - DNA, 2354 bp, Homo sapiens
  misc_feature (2180)..(2180): n equals a,t,g, or c
  misc_feature (2255)..(2255): n equals a,t,g, or c
ggcacgagaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgtgctgtttctggatccagccatgtgtgcgcttgtgtggacctgaggctgctttctgttcccaaagcttgacctgtgtacagagataattccttggcaatgttggacatagaatgcaggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttcttncctgacgttgtcccctttttttgtactgatccaactgggagaacctcagccaatgctggaagtatgattgaagtncctctcttttgtgactcttgtacagcttaatgtgcaataaaggaaaagttatatctgtcaaaaaaaaaaaaaaaaaaaaaaaaaaaaaaaaaaaaaaaa

SEQ ID NO: 2668 - DNA, 744 bp, Homo sapiens
  misc_feature (14)..(14): n equals a,t,g, or c
  misc_feature (21)..(21): n equals a,t,g, or c
  misc_feature (706)..(706): n equals a,t,g, or c
  misc_feature (744)..(744): n equals a,t,g, or c
gaattacccttccntaagggnaccaaagctggagctccaccgcggttggcgcccgctctagaactagtggatccccccgggctgcaggaattcggcagagcgggtttagtgattatctttattgatcagaaaaaaaaaataaactcacattgttgggataatctaaaaataacatcatgatattacagcataccatgaagaagttaactctaaaggcctacagtatataatagtttgagtttggaatcttttttttgtgtcatgcataactcaaactttgcatatcaccttcttcttaatctccagtgagtaactgctttatagtttcagactccaagttaggtcagaatactcaatatcaaatacttttgataataccacaaaatttaccaaagacatagatattttaaaaacaaggaaacaaacagaaatcttagaactcaataactcaatggatgatataaaaaatacaaatgagaacttcagcaataaagtagatcaagcaaaataatgaatttctgaacttgaagacaggtcttctgaaataacccagtcagacaaacaaaaaaaaaaaaaaaaaactcgagggggggcccggtacccawttcgccctatagtgagkcgtattmcaattcactggccgkcgttttwcaamgtcgkgactggggaaaaccctggsgttacccaacttwaatcgccttgcagnamatycccctttcggccagstgggsgtaatagcggaan

SEQ ID NO: 2669 - DNA, 372 bp, Homo sapiens
  misc_feature (368)..(368): n equals a,t,g, or c
gaattcggcacgaggtggaacccaaaacgggttttggtttgctgtgctgctatgaaagtacacaaaagtgtgctgtgtacactttgtgattgcctctgaaattcgatgtggtttattctagacttgggtgtggtgtaggcagggcctacatccaaggagctgattggtcaatgaaggcgcctccctctcattggtctctgtggctgtcattctgtcaccctcctccctggctctttgccctcaataaactggctcaaagagccttggaaaagcattttattcccagctcttatgcgaactctgtgtagaccctggacaactaaatctgctttcccatttgcaaaaaaaaaaaaaaacccggggggggncccg

SEQ ID NO: 2670 - DNA, 427 bp, Homo sapiens
ggcacgagcatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtgagtcacagctttgtttccacgtattattcagtttatttctgtttccttacttgtttacattccgtggtacctacttacatgcttaggagtcaaatggattatgacattaggaaaaaagcagaataaaagagattgaagtcttaaaaaaaagg

SEQ ID NO: 2671 - DNA, 304 bp, Homo sapiens
cggcacgagaaaacatccaagcttcttacctgtagatagaatcagccctcagttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaaaaaaaaaaaaaaaaaaaa

SEQ ID NO: 2672 - DNA, 400 bp, Homo sapiens
ggcacgaggaaatgagttaagactttggggactgtgggaagggcattgttgtgttttgaaatgtgaggacatgaaatttgggagggaccaggggcaaaatgatatggtttggctgtttccccacccaaatctcatcttgaattgtagttcttagtccccatgtgtcatggaagggacctggtgggaggtaattgtaggtggtttaccccatgctattcttgtgacagtaagttctcataagatctgatggttttataaggggcttcccactttactcagttctcattcttctccttcctatcaccatgtgaagatggacatgtttgctttcccttctgccatgattgtaaatttcctgaggcccccccagccctgcagaactgtgagtcaattaaagcgg

SEQ ID NO: 2673 - DNA, 703 bp, Homo sapiens
aattcggcagagggcgatttgtgcatgcctgtgacacctttctcttcattcttctgtgcctctatgattgttacaccttttttattttttttcttttttgagacagcctgggcaacagagcgagactccatctcaaaaaaaaaaaaaaaatatatatatatatagatagatagatagatagatagatagatagatagatctgtgcttccttgttcccatgttttgtacatgctatttctcgcatctgcaatgtccattctcttcttccattccccaccttttcctcactcccaaatggataactcacacttgctctttaagattcaacttacatattattttctttgtgctccagtagctctttgcatttctcttataggaattaccatgttgtgtcttgtctgtctgttagtttctctcataagaatgtaagttcatcaaaggaatggactgtgtctcattttagctttgtttctgagcccaaagctagaattgtgtttgtttagcacaatgcttggccacagcaagcatctatgatgttgtttaaactgactttaatcctataaatcaatgtctcccctcaaatgtgtcccactagtaccaggagatttttcaggaaaatgtcctatagtctaataatttggcaaatcacaaattctatgtaatagtgtatataggctctagaaagactagcaaaaaaaaa

SEQ ID NO: 2674 - DNA, 675 bp, Homo sapiens
aattcggcacgaggaaaatatagaaccttttcatcatcacaggaagctttcatggacagtgctgctctagagtatatcaatggcattggaaattcataagccaagagtgtctttcaaatatcagctaattaatgaactaatatcacgtcagatatcacctctataacatttwaaaaatactcattgtgctattatggctagtgctgcaatgaagatgaaatcaacctaaatgcccatcaatgacagattggataaagaaaacgcagtacctatacaccgtggaatactatgcagccatgtaaaaagaacgagatcatgtcttttgcaggaacaccaatgctgctattattctcagcaaactaatgcaggaacagaaaaccaaatactacatgttctcacttataagtgggagctaaatgataagaacctgtgaacgcaaagaaggaaacaacagacgctggggtctatttgagcgtggagaatgggaggagggagaggagcggaaaaggttaactcttgggtactgggcttaacacctgggtgatgaaataatgtgtacaacagaccctcaggacatgagtttacctatgtaacaactatgtaacaaaccttcatatgtagcccccaaacctaaaataaaagttcaaaaaaaaaaaaaaaaaaaaaaaactcgag

SEQ ID NO: 2675 - DNA, 432 bp, Homo sapiens
ggcacgagaaggtattccatgcaggtgaattttctaaaaatactttactgacacaatttaaaaacacttttgatgctcatctttattaatcatattataattagccttttccccccagaatatatagagcatagtttaacccttttttaatgactcagaattatcattatgaccagatactattatctttagagtctgctaatgttattggtctttttgaccctgtgccaaatggtcccaggctagcatgccttctgagttccttgcttttaagaattgtattcctaccacatactccccttgccccttgctctctactttaattttctatttcagtcaagtgtatttgtccctaacagtttcccttcttattttccccaaatgactatcagctttgaaatgataagccagaaaaaaaaaaaaaaaaaaaaa

SEQ ID NO: 2676 - DNA, 794 bp, Homo sapiens
gcacgagtccagccttgcagcccctcatgagtgtggctgcagacatgctgtccggcccctccctgtgctgctgaccccctctcatgggtcccccagtgttccgtccccatccctgagttacggagccgcctgccgatgccccgcccatccctgactttgggtctcctgctccccagccagcacctctgcgctaaccacaccctcctacaacatttttttaaccccaaaattatagcctgaatgttcgcttttagtctggccaggggatctgactcctgagttggttgctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaa

SEQ ID NO: 2677 - DNA, 425 bp, Homo sapiens
gaattcggcacgagagaagggaaggcaaggggctgaggggagggaaacagggatgcatttctgttttctggtatcattatacattatttaaaatttatgcatattttggaaaactagttgacctgacaagaataagacagtctaaacttgtagagttaaacagtccctccatggtgagattttagactgattcagagttgtgttaacctaatgactgacacactttattgtggattgtagtaaataacaacaaagctaggttttatgatgcttttctcctactaaatgtgtgtcacagccatttacaaacccatttggtgcaattcttatccttgaggtttatttatttgctttttaaaatatattgcattgtcttattttaaaaaaatagtcaacagaaataattgcaaggaattgtggaaaag

SEQ ID NO: 2678 - DNA, 1489 bp, Homo sapiens
  misc_feature (240)..(240): n equals a,t,g, or c
gtaaagatttaaattatttgaagcatagagatttttttttatgttttgttttctaattgtcatggtaggtcatgtcatactaaatacaagataggctatagagttttaatttactgtcattgaacaatttgcattgtttaggaggtactaggatgatcaactgattgaaaaattcatcagtgtgttaatgaattttttcacccctttagatatatgctgaaaacatttagcatgagttgnattttaataccaatttttcaatattttttcaaattgagacataaaaactaaggcattttaaatatctgtgctctaataaaaatattttagaaatattcattgatgctgctttttacacaggagaacacaaagttatacctcaatttacttgaaatggaatatagtggtgacctcaaacaaaatgaagaaaatatcckaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccaaaaaaaa

SEQ ID NO: 2679 - DNA, 323 bp, Homo sapiens
gaattcggcacgagctgcctctggcctctgtgtttaaccatttgcggaactgccaaactgttttccaatttggtggcaccattcattgtagattcccaccagcaatgccccagggttctcatctctccatctcctcgttagcacttgtaattgtctacctttgattatagccaccctagtgaatgtggaatggcttctcatggtggttttgatttgcatttccctggtgtttagcatcttttcacgtgcttcttggccatttgtatatcttcttttttttggagaaatgtctattaaaatcctttgcccatttttaaaaaaaa

SEQ ID NO: 2680 - DNA, 674 bp, Homo sapiens
ggcagagcggcacgagaaattttatatggagttaacatgggaaaccttatgatggaatttaaagattatctaatgtagagtataaataagatggttgaaagtgtgaaattgtaatcagactgtttatatgctaaagtttatcctgtttcttaaactgcgtaatgtaggtaaccttttctcttacatttaatgaagtagaatacaccttttaggagcaattaaatactgaaatggttaatttgtgtttagaagtgtgattttcttttttacttagagttcattttgccttgtatagaagtacagtttttaaaaactcaaaatgacctagaggaagtttcatttttaggggcggtggaggtcttaatcagaattagttccgcagttaaatagcaaacagtaagttgtgagtagtcaaggatgggatgataagagcagtattttttgcaacttaaaatgaacattttcttaaattatcagcaaggcttatttgaccaaagatgaggtaggattaaggtgatttatatttacctttttaaacttttctgtatttttttattttcaaattttccataaaaatataaggacttgaagatcaagaaaaaatttctgctttggctcacaaaaaaaaaaaaaaaaaaaaaaaaaaaaaaaaaaaaaaaaaaaaaaaactcgag

SEQ ID NO: 2681 - DNA, 650 bp, Homo sapiens
ggcacgagctgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatccggcctcgcaggctgtactttcatggtgctctctaccttctggcccccatcccggaacattcctgagtgaattcgcaagcgcactagcatgtgatattagggagtttgcaataaattattgaggctgaaaaaaaaaaaaaaaaaaaaaaaaaaaaaaaaa

SEQ ID NO: 2682 - DNA, 757 bp, Homo sapiens
gggctgcaggaattcggcacgagctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgcaaaaaaaaaaaaaaaaaact

SEQ ID NO: 2683 - DNA, 818 bp, Homo sapiens
  misc_feature (2)..(2): n equals a,t,g, or c
  misc_feature (6)..(6): n equals a,t,g, or c
gntccnagctccccgcggtggcggccgctctagaactagtggatcccccgggctgcaggaattcggcacgagcacaaaggtaatttcaaagctaaaatcataagtaggaaaggcattgccaataagacagatgttctctttggaagtcctctttctttttgctgggtagcatctgagacttcttcaaccttacaaaatgatgaaaaattaaagaagataatagcatttgtagttttcatgaatactgaaatcacacattcatgtacaagaaaaaattgtgcatggcaacacacgtccatactcaaggctgcacatacataataaaaaatacaagcgcattgttttttcttacattttataaacacatgctcatttgattgattgtgtagataaagtagcattgttctatcatctttccctcaagcttttagatataattctttttggagccttattgtgtgacatgtgaatggagaatttgatatttaatatttgktcttttgaatcatgtccaggggctgggtagggtggttcatgcctataatcccaacagtttgggaagctgggcagagaggatcatgagcccaggagtccaagaccagcctaggcaatatagcaaggccttgtctctactaaaaaataaaaataaaaaatttagccaggcattgtgatgcacacgtatagtaccagctaccgaggaggccgaggagggaggactgcttgatcccaggaattctagattatagtgggctatgatcattccactgctctccagcctgggtaatgaacaagaccctgtttcaaaaaaaaaaaaaaaa

SEQ ID NO: 2684 - DNA, 821 bp, Homo sapiens
  misc_feature (40)..(40): n equals a,t,g, or c
  misc_feature (816)..(816): n equals a,t,g, or c
  misc_feature (819)..(820): n equals a,t,g, or c
tgttgtgtgaaattgtaaccggataccattttcccccagnaaccagctatgcccatgattacgccaagctcgaaattacccctcactaaagggaccaaaagctgragctccaccgcggtggcggccgctctagaactagtggatcccccgggctgcaggaattcggcacgaggggaaactcactggtaggaatccataaactgtcctcctggtgggctgtaaacaactcaccctctatgcatctcacatcaaaattccagtttcttgggaaaacaagtctgtttgcccaatttgggtcatatttccacctccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagaaaaaaaaaaaaaaaaaactcgagggggggcccggtacccagtgcganccnnt

SEQ ID NO: 2685 - DNA, 735 bp, Homo sapiens
  misc_feature (3)..(4): n equals a,t,g, or c
  misc_feature (16)..(16): n equals a,t,g, or c
  misc_feature (22)..(22): n equals a,t,g, or c
  misc_feature (710)..(711): n equals a,t,g, or c
  misc_feature (734)..(734): n equals a,t,g, or c
acnnaatggcacatcncccttnctattgggaacacaagctgagctccaccgcggtggcggccgctctagaactagtggatcccccgggctgcaggaattcggcacgagcaagggttcccttttctccacatgcttcccagcatttgttattgcctttttgctataagccattttaactggggtgagatgatacattgtagttttgatttgcatttctctgatgatcagtgatgttgaggaccttttcatatgcctgtttgccatttgtatgtcttcttttgaaaaatgtctattcaaatattttgcccagttttaaatcagattaaggtttttcctatagagttgtttgagctctttgtatattctggttattaatcccttgtcagatgagtagtttacaaatattttctcccattctgtggcttgtttcttcactttgttgattgtttcctttgcagtgcagaaactttttaacttgatgagatcccatttgtccatttttgctttagttgcctgtgcttgtggggtattactcaagaaatttttgcccagactgatgtcctggagagtttccccaatattttcttgtagtagtttcatagttcaaggtcttagatttaaggctttaatccattttaattatatttaaaaaaatttaaaaaaaaaaaaaaaaaaactcgagggggggcccggtacccaattcggggatnncccgttccgtcccccccccccgna

SEQ ID NO: 2686 - DNA, 1372 bp, Homo sapiens
  misc_feature (386)..(386): n equals a,t,g, or c
tcgacccacgcgtccggcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcwagtgtctctgggagccccctcttctctgtcatcgtcargctccccacttgcagtggccgtggtggctgcacatgctcccggnatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggytggagaakgggggaatatgggaggattatctcctatcacagggagcgctctgagggcaaggctgygtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtktctccctcaaagtggggctccytcaggacagcgttgtktctcccctcagactgcggctccctgaggacggggctgtgtctccctcagactggggctccctgaagaaagggctgcttctccctcagactggagctccctgaagatggggctgtgtccccytcagactggggctgcctgaggatgaggctgcatctcccttcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacaccatttgtcacgctttgatgaatgaaacttactaagaataaaaaaaaaaaaaaaaaaagggcggcc

SEQ ID NO: 2687 - DNA, 580 bp, Homo sapiens
  misc_feature (3)..(3): n equals a,t,g, or c
ggntcgacccacgcgtccggacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggaaaaaaaaaaaaaaaaaagggcggccgc

SEQ ID NO: 2688 - DNA, 2120 bp, Homo sapiens
ccacgcgtccgagaaagtccaggcaggaacctggttgtatatgggaaggaactgatccaagttgggagtttaaaatccaaggaaccagctcagatctgagacttgtgaactaaccttcggggctaacaggccagcaggtcagccaggatggtgagggtgactttgctcccaggcagttttccactccaccctcaggctggaggttgttttaaatattttatgtgagggaagaaagggaagccagcatgatcatctggggctgtctgctaatcgtgagcgtgtgtgtagaggggacagagagttttagacttggcaacagcaatcttttatttatgattaagtataagagtaggatgtaaagtccatttgcgttttagctgttatttaccatgctttaagttaggtgattttaaattattcacattaaattattcacattctcatcgctttagtttcttaaccttatacttctttcaagatgtccgccaacccctgaaaatatgtggcacagttgttggtgcacatatgtgtattttgttgggttagaggtgcacctgactcagtaaagattcagtctgctaattactgtattgctttctcttagctcagatggtataatgcaagcatatatatttcttcattgtaaactgttctcaagaggcgattttctactgattcaagtaaattatagagaggtgagacagatacatttaaaatttacatctttagtctaaccacaacattttttctcatattaatcagcaagcttttaatttttagttcagaaaggagaagtataaagttggaaaaaatgcatgtttgaaagcacacaatgctgccctatatagatagagagagagagagtataaaaatcaaaatgaaacacaacctgcaaatgtcagagaacatatttggaagaggaaatgcagctggatttgcccaaatttgcaaaacaccagatgttcccacagcttgtacatgatgttaaaaatgtaaaataaatgtgtactattcatacacagtgtgcagttttcaaatgtgtacccacatttaatttagaaagaaatttttggaaagaactggtaagctaattctcgagtgcataacaagaacaataagcaattgttcagatactagaattcagaaaggaatattcccaaggcctgaactgagtgcccaatccactggtaaaacataccagagaaggctcttcactttcatggtaacagtcattccattgccatttacatttgcagaattcctagaatctctggggaaaatatttacaaatagtattatgtcctgcagtcagagagtgaatttgtgtgccatttgagatgattaatatgcagaaggaaaaaggaagcaaatgtttaaagtgtatttgtaccaaatctaaatgcttttttttgttgttgttgttgttgaatcagattagagttgctcctctattgcttgtcaattcagctgttataagcatttttatagaagggcagagaacaagtgaatgggttagaaatccaggaaaatggttgtaaaagaggctgaaaggcaggtcagaacacaatttgcttggtattaggtggttagtaatggggagcatatgtataatcttagcctttgtgttttatactttccacttgctgtcaatagctagtactgctacatccatagataaatgcatggcaaatacttctctctcatatgaaatgctgtcaagaagtttgccaggatccttctttaaaaattcccaggtaatcatacagtttaaaaagtccttctggtaccttgcccagtgttactcaacctggaattagataggtatttacccactcccctttcccccaccttgcacgtgctgcctttccaactcccaccgtttgtgattcattgccatcgtaaaccactgcttctaatgggaaacatgttgtctcctttggattgtagcagaaaaattattgagaacctcttatctagcctactttctaaccttcaaactcatttctattgataattaagccagtatccctgcttacttgctttatttatttaataaaaggtatcttttgcctaaaaaaaaaaaaaaaaaaaaaaaaaaaaaaaaaaaaaaaaaaaaaaaa

SEQ ID NO: 2689 - DNA, 1467 bp, Homo sapiens
ccacgcgtccggtctgaaaggaagtggtttggattcatgatgccaagctccacactatggagctgggaattccagaattgctttgactcagatattaatggagaaagtcatatccattaatggataaagccgtatctgttatggataaagccatatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggacggaatttgttggcaagaccattttctgtattggatattcttcccaacagtgtccaccccaaaaggctttcagccaaaacatctgagcctaggtaggtttaccaagggaagccataagtcaagaagcatcagagtgaaaaggagcacttccttcattttacgcccggaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgttaaaaaaaaaaaaaaa

SEQ ID NO: 2690 - DNA, 1917 bp, Homo sapiens
  misc_feature (1862)..(1862): n equals a,t,g, or c
  misc_feature (1892)..(1892): n equals a,t,g, or c
tcgacccacgcgtccgggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagctttttttttttttyccttttycaaatatgtkggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagargaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttytgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattytggaattttaaaaataaacatgacatcttatcatgagaaacatttacagtttttgcttttactacaagatactgtgaaatgttctgctctgtcagttgtgaaagtatgaaatttaagtctatcactacaataatatttwgtttttagtgttcatttctttcctcctgactacattgagatgagttagattgagtgaaaggtaaacactaacatttgaattgaggtaatttccactgtggaaaacaaactgttgttagtaaacaggcatcagctttgagacacagaaragtcatccaaaccagaagattgggaacttcctcaattactttgtcttccatttattgcattcaattagtcaaaaatgttgttaattatacattttaaagactatttttggtaaggtctatgacacattcaaaatactacatayaagtttgtattatcataaataatccaraagaaaacatacatgtaaccaccaccatctggaaatttcacactaaattataaaacattccatcactgcatgtattgntaatgtcgcttatgaatccacttcttcctnatctgtagagttaaaaactacttag

SEQ ID NO: 2691 - DNA, 1164 bp, Homo sapiens
ccacgcgtccgcccacgcgtccgcacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaaaaaaaaaaaaaaa

SEQ ID NO: 2692 - DNA, 1180 bp, Homo sapiens
  misc_feature (25)..(25): n equals a,t,g, or c
  misc_feature (35)..(35): n equals a,t,g, or c
  misc_feature (40)..(40): n equals a,t,g, or c
  misc_feature (1174)..(1174): n equals a,t,g, or c
caggaaaccagctatgcccatgttnccgccaaggntctantcggcctcccctatagggaaagctggrcgcctgcaggtcccgggtccggaattcccggggtcgaccccacggcgtccgataaaatttagtgaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaaaaaaaaaaaaaaaaaaaaaccccggggggggncccggt

SEQ ID NO: 2693 - DNA, 2056 bp, Homo sapiens
  misc_feature (2038)..(2038): n equals a,t,g, or c
  misc_feature (2054)..(2054): n equals a,t,g, or c
gccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagrtctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgcgtgtgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaaaaaaaaaaaaaaaaaaaaaaaaaanaaaaaaaaaaaaaaanaa

SEQ ID NO: 2694 - DNA, 825 bp, Homo sapiens
aattcccgggatcgacccacgcgtccgacatctttcaattgggagaatatctgtgtctaagcacaatatcttcacactgtgctgtattgctgctgaactaaatgcacttttccccacatatggggcactggcttcaaacaattcagttcagtatcattacttttaatctcatctttcctttcttggtagttgttaatacagttatggaaaagaggcacattgcatagaagccattggggagttcagtggaagttctgtaagatgtgcatgtactatttgatgcgttttctttgcttcactgcttttaatacttagcagtattgttggtctaagtcaatttgattattgaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctaaaaaaaaaaaaaaaaaaa

SEQ ID NO: 2695 - DNA, 3107 bp, Homo sapiens
ggaatgtttcaaaaggatatgatgaactgaggcttatcgagtcagggagcagaaagctgaaataagaccgctaagctctaaacaaatccgttaaagcttcacagggcagagcagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctaactgtataaagaaaacacagtgggttgtgacaaggatgacatgaaaatacaggacaattctgacaatgtaggggctgattttatagtgtaagaactattaatgccccttgsttcttttttctgcctcttgctcttgtcttttggacatttcagtgawtgtaagttcttcggtcatgtcagcccctgtcatcaacttgagttacagtagatggggcagacatggagtgtttgctatatagaactatctgtttgttttacttccttgtgcgctttttgttctctgwtctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgaaaaaaaaaaaaaaaaaaaaaaatt

SEQ ID NO: 2696 - DNA, 939 bp, Homo sapiens
  misc_feature (935)..(935): n equals a,t,g, or c
  misc_feature (938)..(938): n equals a,t,g, or c
ggtcacgagcggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaaaaaaaaaaaaaaaaaaaaaaaaaaaaaaaaaaaaaaaaaaaaanggng

SEQ ID NO: 2697 - DNA, 588 bp, Homo sapiens
ggcacgagcataacttaggccgggctgaccatcatcttggatggcgtcgtccttgttggcgcagattgtgttggggggctggttgtttgtgggcgcctttaatattcaaaggggagaatactgttctgattgaggcattatgcccgctgagttgtgatattacatccatcatcttgttcaaataaatagcgccgtatctatatgtcggaatgaataaataaaagtgctgcagcagggaggttgggctggaaaccagaggcccacgatgctctttgctggctttgaaatgcccttgcaaagaagtattgaaaatttaccagcccacaatgagtcttttaaatctccttttccttgctaccaccaacccctgcaccaaccaagaatacgttgccagcagagttctttatttagttggcattggtttttattgaccctgattgaatttgaaattgtaaggctgagagaggatttgcaaaacatttgaatacattttgctcacggtattgttttgtaacttggaggaatttatctttttagccaatcaggttaaggtcaataaatttggtttttaaaaaaaaaaaaaaaaaa

SEQ ID NO: 2698 - DNA, 2317 bp, Homo sapiens
gctcgtgccgagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctrgaragttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactawaaagcattccacaaatatgagatgatggtattatccatccataaataggtagatatatctctattttatagtttcagattaaacaaaactgatatcaatagtaaaagtcaaaaaaaaaaaaaaaaaaaaaaaaaactcgag

SEQ ID NO: 2699 - DNA, 1290 bp, Homo sapiens
ggcacgagctggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcataactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgaaaaaaaaaaaaaaaaaaaaaaaaaaaaa

SEQ ID NO: 2700 - DNA, 2290 bp, Homo sapiens
  misc_feature (2283)..(2283): n equals a,t,g, or c
caaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactctaaaaaaaaaaaaaaaaaaaaaaaaaaaaaaactagttctcctccaataatgtccaaattgtaatgtgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaaaaggggggcccggtacccaattcnccctata

SEQ ID NO: 2701 - DNA, 1934 bp, Homo sapiens
gcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgkaatttacagtgtgtaaatattttctaawtgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccatggttattccttactcatgaacagtgtcggcgcacctcattatctgtgcatttgtttttcctgggcagtcctgtcagccagttaatccaccagctcttaggaagtaaatacagatttttttctttccttttttttttttttaaagattttatactacatcttgttaaagtcctatgaatgtgtgtgtgtgtgtgctattaaaactgctttttctcagtttgaaaaaraaaaaaaaaaaa

SEQ ID NO: 2702 - DNA, 357 bp, Homo sapiens
  misc_feature (22)..(22): n equals a,t,g, or c
  misc_feature (39)..(39): n equals a,t,g, or c
  misc_feature (171)..(171): n equals a,t,g, or c
gcctgagcccaccgtgcccggncccacccgccattaatncctttggccctcctcccacytactagcccygaggctgaaagtatttaagatcaatgaagagtgacttaggtcctgagttgcagcsttcccttatcctacagaatacgataatatctgcctatgagaaggatncctgagacattgaaataagatgattatataaagtgtatacaagcacaacataactttcttctcacatatccatcacagtgcaaatctaaccccttaactctgtaaaactagattgcaaagaatattgcatgtaatatttttcctttgcctcagaaatgggtaaacaaaatttaagaagaaaaaact

SEQ ID NO: 2703 - DNA, 1469 bp, Homo sapiens
ttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgttgtaatttatgattcctggttatgtatttttgtgggatcctgcagtaaaattgacttttttgtgtctttgggagatttaaattgcgctaacagtgttgcgcaaaaatgagttcatgccatttaacatattggattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaaaaaaaaaaaaaaaaaaaaaaa

SEQ ID NO: 2704 - DNA, 567 bp, Homo sapiens
caggtttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccaaaaaaaaaaaaaaaaaaa

SEQ ID NO: 2705 - DNA, 1679 bp, Homo sapiens
ggcacgagctggtgcctcacacagcgcacgcgggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagagttgagagcttccagcagctgctcaatgctcggacacaggaattcattgaagattgctgtctcccccttttgggggtttagtggcatttgtgaaggaagctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtacccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgaaaaaaaaaaaaaaaaaaaaaaaaaaaaa

SEQ ID NO: 2706 - DNA, 1598 bp, Homo sapiens
  misc_feature (1508)..(1508): n equals a,t,g, or c
aattcggcagagcatagtctttcaaatttggacatttaaaaaagaaacttttactgtagtcatgaagtagtatcaaagtttaccacaagtttgtattgagagaagaacaaacaatatatgctaatatgaaaaacagctctacttagaaagctactgcttgggttttcttattaggcatagttctccagactgagttggttttactcatctacatgatttttccttgccttatggaacagaaattcaggcccactcgaattcagttattttagggctctttaaaatccagtatttgtgatttaaatgatgcggagggactttcattacctgtgtctttgcttatttctctctggccctcagaacaccccaccctgacctttaggggaaattgacagaggcagagggtttcacctgcctcaattgtcaccagccctgttacattcttccttccaagccttagcctcacagggaccttctcattattgaacaawtgccttcaaagcagtagaatagcccaattgttatggagattaaagataccgattgcaaaactcctgtaaataaaatcttcactgacaaacccagtttcttttcataggcttttcttctgtaatctctttctggcagaacatctcatgttttgatgttagagattcagttaccaaccacagtaaataaagcaaaataataatagaaaaatagtatagaactcaccctaaaaacaaacattggccaaccatgtttattttttgtctctctttgcactcctgagaattgataggggaagaatgtaccacctctaattcaggtgatttctgattagcaagctatggaaagtcttcaggttgagttttagccagttcacgctcccctaaatggcatggaatagactattttctgttttaagaaaaaatagaacaatggcactaaatgcttgactgaatgtttgactaaatgttgactgaatcatggataggaaagattgggcagaaaagacagccactgcctccagacacaggatgccacaatcctgggcaccatcattattccatacaaccttagggtcatttttagggtttagaactttctcaatagggtttcaagattttgaaaagtgtcttccaattctgatctccgtagatcctgttatgggaattaacctttttggaaggggattcttgttcttaaagatgaaattccctactttctttcctggagggaatcagtatgggcagagggaagaggagatggcgattctgacctgtgtgtctcatgtcacctaacacctatggggtggcatgaaacttgagctttaaaacacaccaggggccaggcacagtggctcatgctggtaatcccagcactttgggagaccgaggtgggtggwtcacctgaggtcaggagttcgagaccagcctgccaacatggcaaaaccccgtctctactaaaaatacaaaaatcagctgggtgtggtggcgggcacctgtaatcccagctacttgggaggntgaggcaggagaatcgcttgaacctgggaggcagaggttgcagtgagccgagatcaggccattgtactctagcctgggtgacaagagtga

SEQ ID NO: 2707 - DNA, 824 bp, Homo sapiens
aggggagagacttagttacacaaagtcttaaaatattccttgattgtgctgtgtcaaagcatcagaatgggacaaagctgattctggagaaaggatgtacttgctgcccttcagagcctgagctccacccatgctggataagtcagaatgctggcactggaagggcccttaatggacagctcgtccaactccctcatcttacagatgggagaaactgaggtccggagaaactgaggcccagattaggagcaagacttgcatgcctagatccttctttgtgtgcctcttccctactgcaagctgagacccaggtcccctggtttggctggtcgtggctgcttgtaaagtgaaggtgcttctgtgactgaatgactccaacaatgtccaatccctaatcctttcctcaccaaagaagatggcccttggggacagcagcacttgctgagcaggagcatgagtcaggtgaccacctcattccagtttgctcaggactcgccctgttttagcactgaaagtctcacagcggctgggcatggtggctcacgcctataatcccagcacttgggaaggccgaggccggtggatcacttgaggtcaggagttcaagaccagcctggccaacatggcaaaacctcgtttctactaaaaatacaaaaattagctgggcgtattggcagatgcctgtaatcccagctactcgggaggctgaggcaggagaatcacttgaacttgggaggcagaggttgcagtgagccgagattgagccactgcactccagcctgggcaacagcacaagactctgtctcaaaaaaaaaaaaaaaaaa

SEQ ID NO: 2708 - DNA, 2023 bp, Homo sapiens
  misc_feature (486)..(486): n equals a,t,g, or c
ggcacgagcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttattatttgtaatgcacatggcaaagcaaagacgtttgtgatgaaggaactgctcatctaagcaaaagatttgagtatgatatgataaaggctttctacattctaatttacttttccccccacttgaatgtgttttaaaggctaattatcagctcagtaaagcagtgagaaactgatcaaattgcacttgtnctcctacaagcaacctccacgcaaacacctcgtactgctacaggtgtgtcatttcctttaataggaccagggaccatgtaactgaggtgagggttgtagtaaatgctcccagtgtcagtatgcctgttaattttaaaagctcccttacttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggttcaaaatcaaaacaaaaacccccaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacaaaaaaaccgaactggggctgggaaaagacagttattgacactgatgtgcaatgaagtgacaagatgagagcagaatcgtaagagctttgaatttgaagtgagttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaaa

SEQ ID NO: 2709 - DNA, 942 bp, Homo sapiens
ggcacgagtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcacagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaaccccctgacgcccggcagccactatgcctaggcccatgtggtctgggccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacaaaaaaaaaaaaaaaaaaaaaaaaaaaaa

SEQ ID NO: 2710 - DNA, 884 bp, Homo sapiens
ggcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcagattcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtgctcacgcctgtaatcctagcactttgggaggccagggtgggcagatcacctgaggtcgggagttcgagaccagcctgaccaatatgatgaaaccccgtctctaaaaaaatacaaaaattagccgggcgtggtgtcaggcacctgtaatcccagctactcaggaagcagaggttgcagtgagctgaggtcgggccattgcactccagcctgggcaaaaagagtgaaactctgtctcaaaaaaaaaaaaaaaaaactcgag

SEQ ID NO: 2711 - DNA, 2637 bp, Homo sapiens
acgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcagtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagrtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaagtcgacgcggccgcgaatccggaccggtacctgcaggcgtaccttct

SEQ ID NO: 2712 - DNA, 1889 bp, Homo sapiens
  misc_feature (1859)..(1859): n equals a,t,g, or c
  misc_feature (1864)..(1864): n equals a,t,g, or c
gttctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgataraactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccacccccccccttttttttttttggtttgttgttgttgtagtagtctggtgctggccacatttaagtcttaaaaatttttaaattttgytgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgyagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaaaaaaaaaaataaccaatttttcttaatacccagaagggattttactcaatatttccctaggtaaggaaagggggggttatnttccncttaaaaccccaccgtgtattacaa

SEQ ID NO: 2713 - DNA, 785 bp, Homo sapiens
ggcacgagattttcatagctggcactcggggctatggctgaagtgtctgagaaaagaggaacgtggaaaagcaacctgatatcactccactgggaggccagaggggctctcaaataggacctgggttccaggcatgcttccccagggagagcaggagctgctttctcagtggggtgagaggccagcaggctgggtgggctggctggcatgtgcccaaggctcctgttcagctgggcttttctctcccgataggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacaaaaaaaaaaaaaaaaaa

SEQ ID NO: 2714 - DNA, 854 bp, Homo sapiens
ggcacgagccagcaacatcattgatgtgtctgctgcagactcacagggcatggagcagcatgagtacatggaccgtgccaggcagtacagcacccgcttggctgtgctgagcagcagcctgaacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcaaaaaaaaaaaaaaaaaa

SEQ ID NO: 2715 - DNA, 753 bp, Homo sapiens
ggcacgagcttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaaaaaaaaaaaaaaaaaaaaaa

SEQ ID NO: 2716 - DNA, 864 bp, Homo sapiens
  misc_feature (251)..(251): n equals a,t,g, or c
ggcacgagctgatttttagccacgccacgtcgtatgaagtctgcctgaggctgaattatatattaacttgtggatcagtgagcccccgctgctgggggagtgcaagctgaggccgccatctgagtgcgttgaacaggaacacccagagccctatattgcaagaggtttgaactatgcaacttttttctcttttcttttctttcccaccctccctccatccctcgcccattcctccctccctcccctactcntcccgcctccctccctctctccctccctcctgattgtttctgctgcttggctctgggctgtgggtaaactccagcactgcagcttcatctgggagacccacagctcgtttgcttccttccttccttccttccttccttcttttccttcctctctcccttcctccctccctccctttctccttccttcctcccttccttcctttcttcctctccttccttccttcctttctccctccctccctccttccctctctccctttctttctttctttgttgcttttttttttctttttttaaaacagggtcttgctctgttgcccaggctggagtgcagttgtacaaccatagcttactgcagcctcaaactcctgggctcaagtgatcctttcagctcagcctactgagtagctagtactgcaggtgtgcacctgtagtctcagctactctagaggctgaggcaagaggatggcctgaacctaggagttcgaggcttcagtgagctgactgtgccagtgcactccagcctgggcgacaaaagaccctatctctaaaacaatatggaagtgtaagaagttggggaaataaaaggaaaaagaaaaaaaaaaaaaaaaaa

SEQ ID NO: 2717 - DNA, 1863 bp, Homo sapiens
  misc_feature (1825)..(1825): n equals a,t,g, or c
  misc_feature (1836)..(1837): n equals a,t,g, or c
  misc_feature (1851)..(1851): n equals a,t,g, or c
ggcacgaggggcagagtagagatgaatagttgggtatggcacaggcggctacctgttgtatcagtgggtatggtttacctcacatagggcacctacacgtgaagaaatggacaacagaactgctttgtctgttggcatggttgtcttattggaggactgcattattggaggactggtttcctcttccctaccaggacaatcctccgaagttctttgagctttttctactgcctatttttgcagcccaggtcagttgatcaggaggtgtggccttgtatttggtccaccttgagtcagatgccgctctgcttactgagtatttttatattggactcaaatcatgatatggaatcatttgtagacagcagacccaccaaaattctgctgcgcatgacagcagggcagatcacggtgttaactgtaatcatcctggtagggagagggtatttatatactataggacagatggagagtgtgtactgctttcagaggtggaattgcaggctacctgggaggcaatgaatttccgcaacctctccaaaagcaaagatagaagacatgcctttctatctcttcacctctgatgcattcagagctacatcataatgttgcacaaggtcccctttaagagtaggtgtagcctgttagagtccaggcagggcatatgaacatagaacaagtaacttctcctacactcagtcgaaaggccacaacctccacacagaaggtgaggttcttcctgagcacaataatgtagttgccagatcttccacatggctgtatcaatgggcttgactctggagccttagatttgggcaagaacatttaatcatcccttgaaggaccaccagctaggattgttaccatgagagaatatggggaggagctatttaagaggatccaaaatgatgtgctgcagggctccaggctcattttattgtgtcagtcttatttaaaggtgtaagtttctcaagcagtgactagttcagggaaaaagaaaaaaaataaaggcataaggctcaaacaatcctttaactgacctctaagcaggtaataaatattactactttttttcttatagtttcttattttttaccttttttatgttcaactctttagtccacttgagatttttttctggtatgttatgtgaaacataaatcacatggacacttttatatggggcactgtcacgtgcaggattacaaatacctgttgtatttattcattcagtcatccattaccagttcaaggcacattgttagggaccagagatgataaacatcaaaaagaatgtgcttcttaatcggtagcagcttattgtccatttaaggagatcagaggtacataaattactgtatatacaaagcagcatgtaaaaagtgccatgtgagtgatgcgaacaagaaagaatataaaatataaggattgttttttatttttacctgagggcatattagggaactagcagtagattccttctgcctggaataagagttttcccagaagaagtgtcacttgagatgtacctacagggacaggtagcaatcttaatcatgacttgttggatataatgaacagaaatcctcttgtatcatctcaatttaaaaagggagctatccacttatcttgcttctaagaatctattctaaaagtaaactggctaaaacatataatgacctatgcacatagctattttttatggtattacttgcaatagcaaaagactgagaacaacccaaatattatcaatatggggctagtttaaaaaactatgatacatccacataatggaggactgtgcatcaaaaaaaaaaaggcgagntgggggcgtanncgagtcgccctganagtgatcggggg

SEQ ID NO: 2718 - DNA, 1114 bp, Homo sapiens
  misc_feature (56)..(56): n equals a,t,g, or c
caagcagcacattctcaagagcacacaggattaagttgtcatcattctgggaaganaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaaggtttttatgctttcaccagccatgtcttaaatacattaaggacaacacatttggtgttcacacttcttccagtaaatgtctggaacttggaaagccacagagtggcattaaaacaatgtgtgttttctttgaggagcagtgcacattttgcaaccactagggaggaattttctgctaaagcaaacccctgttctctgacttgacaacttggccccggactgtggggccccacctgttgcttaccttttgaggtaawtttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcatggaaaaaaaaaaaaaaaaactcgag

SEQ ID NO: 2719 - DNA, 796 bp, Homo sapiens
ggcacgaggttaaatatgcatgtatgcactattggttaatattttctattttctaataatctacaggtgtctgtagttaacgttgagtcatagtgggacttgagaagtggtgcatagccagtaagctgacttttcccacccataaaaatacatgtgttttgttcttgatactatgtgtgtgcacaacaatgggaaggccattgtcagccccccaggagggacacaccgcctgctgttccatatgaacgatgcttgctgatcctgtgtgtggtcacgcagcgcagttctaccttcccatccctgtgcaggtgactgtcagttctttaaattcacttcaagcagaaaaagcccaggaccccagaacagtaacatcacatccctgtttatataagcctgaagcaagacaagcgtcaggaagaaaatttccactttaccttttttctattaataaagaccttttaagtaaaatctctgtagtgcaagttggcatgagcagacttggtaacttgtctttaaaggagaggtttaaattggaacttttaaaaactagaaaacaacagattgataaatcaattttgtattcgctagatgaagaaggtgctgtattattcccagggataataactctcagaattaatcaggctaaaaagatacatttataaaaatattacagttttatatattaagcctaaattcgatgttttgatgtgtaatatgggataaaataacatactgttcagtgcatgaaataaaaactaaataaaaattgtcaaaaaaaaaaaaaaaaaaactcgag

SEQ ID NO: 2720 - DNA, 1545 bp, Homo sapiens
cggcacgagcccctccaggcttaccatcgggtcatcagcttggaggatttcatggagaagctggcacccacccactggccccctgagaagcgggtggcatactgctttgaggtggcagcccagcgaacccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggaccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaaaaaaaaaaaaaaaa

SEQ ID NO: 2721 - DNA, 1733 bp, Homo sapiens
aattcggcacgagtggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaaaaaaaaaaaaaaaaaaactcgagggggggc

SEQ ID NO: 2722 - DNA, 1417 bp, Homo sapiens
ggcacgagctgtcacctgtgttaggctccgtcccctttccgcgttttatccccgtaccagaaaaggatacatttagtgcctcccacccagctccactaaacgggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaaaaaaaaaaaaaaaaaaa

SEQ ID NO: 2723 - DNA, 1389 bp, Homo sapiens
gtctcaataaagaagttcttaaaaaaaaacaaaacaaaatttcagggcccatcaagttatatatatatraaatawatatwttrgtagatatggggtcttgctatgttgcccaggctgatcttgagctccagggctcaagtaagtgatcctcccacctcagcctcccaaaatgctgggatttcaggtttgaaccaccactgtcatccccataaataaagttattggaatacagccatactcattcattcatgtattgtctatggctgcttttgctctacaatagctgggttgagtacttggaacagagaccaaatgtctggcaaaagtctaacatatttactatcttgtacagaaaaaaaatgtcaacctacatctatacttattacaatttcagtaaaaatacagagtttaagtaatttgggaaaatggctttaagaatgaaaaggtgcaaggttatacctgctgaacaaatgaactgtgggcgtgaggtgccattagtctaggcctgcatgttcagggaaggcccaggggagagcctgatgtggcctggctatttgtcatatttgcaaaggggaagtgatgtaattggtctgcaatgaacttgattttcaattgactcaaagatctaaggaggaataaaaattatttaaaaaggaaattagggaagaatggggagaatattggaatcatttaatagaagtacaaacacatagacttttaacttttgcccattaaattttttttaacattttattttcttaaattttttttaaaaaaatagtgatggggtttcactgtgttgcccaggctggtctcgaactcctgggctcaagtgatcctcccaccttggcctcccaaagtgttggggttacaggcatgagccagcctcacccaacccattaaatgtctttaatgtaacttcgggtgtatgagaatttgtaagttgactgtgcagatctctwamaaggttgatatggtgtatttttagaatgttttagactgcacgtgtgtgtgtgtttgtttgtgtgtgtgtgtgtgcgtgctatagaaaacacagcatggaaaccttgttaaaatcagaggctttgattttttattctaaagctttgagttatatgtttaatcagatactatgtgaaaaattttcattaggtacatattgaagtgttccattcaagtctacaagtatatcctcctaaggatttagtttaacatcctttccctgctycaacaagggaatgctttattagagtttcctagaaataatgggactaattaggacctttcatattacctagtccagcagtccaacccatgtgacctccagtaaagttttggcaccaaaaaaaaaaaaaaaaaaaaaaaaaaaaaaaaaaaaaaaaactcgag

SEQ ID NO: 2724 - DNA, 1988 bp, Homo sapiens
ggcacgaggggcgaagtgtgggggatcacttgaggccaggagttcgacaccagcgtgtgcaacatagaactctgtatgtacaaaaaaataaaaaattggtcgggtgtggtggtgcatgcctgtggtctcagctgcttgggaggctgaggcatgggaggatggcttgggctgaggaggtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgaaggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaagctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccggtactttgggaggtctaggtaggagggttgcttgaagccaagcatttgagaccagcctaggcgaaaaagagagactcagtctctacaaaaaaaaaaaaaaaaaa

SEQ ID NO: 2725 - DNA, 1301 bp, Homo sapiens
ggcacgagcagcctgtcccagtcatagctatatcccagcacccagaaccatgcctggcgcatagtagttgcctaataaatgtttgctggatgagtgagtgaacctctctgggccttattttcttcatcggaaaaatagtgataacaatggtaatagtaacaactactgcagtcaggatgatcatgtcaagctccaactcctcgatctggcctgcgatgccctgcatgctgctctcagtgtattcatacctcttcagctgcatttcacacggaagcccacggctctctgcactccagccacctaagccctgctccagtttctcaaactcatcagccccttatctcagggcctttgcaagtgctagatgcacttcyttcccttacttcacctagttcatcaaatagctttttaaattttttttggagacagagtctctctgttgcctgggctagagtgcagtggcacggtcttggctcactgctacctctgcctccctggttcaagtgattcttgtgcctcagcctcctgagtagctgcaattacaggtgcatgccaccatacccagctatttttgtatttttagtaragacggacttcaccacgttggccaggctggtctcgaactcctgacctcaagtgatctgcccgcctcggcctcccaaagtactgggattacaggcgtgagccatcgtaccccagttcatcaaatatcttacccgcattagcacttctttggagaagcttcctcagatctctagaccagactaaatcctcctgtcttaagcttttagagtgctgtgcgccttttctttccagctcttctcagaagtggtagctacagatttgttgatttacttttagtctaatgccagtgttctccagccttttgtcagctctgcaagatacagatgtggtttatttgctccaacatgtaaatgcagaacttagcccagtacctggcatggggtaggtgcatgatgcacgctgggactacacagacaaatggatggttgcctggcatggctcactgaggacactcaacaggtaccagcaccatttatttaagcggatcaactaacgaatgagttagagagtggctggaatggatgtatagcactaatttgtgagagaagacagaatgagaatgtaattccaaaacaatgagcaaacatcagaagaattgaagcaaataactgcaacatttccccagttgtccctctcattgttcttaaaataaaagcatttctgctacggagtcaggcaaataagtgaaaaagccacataaaggaagagcagtgact

SEQ ID NO: 2726 - DNA, 2192 bp, Homo sapiens
ggcacgagatggcatggactttctgtgcttccttctcctgtctggagccacgcctgccctcacctcctcagggacatcctgtcagcactctccacactccttgatgccccagagctgccacactcgcctgattccttgccttccagtctgtctgcaaccagatgcagccaggcctcgcctcccatgagtgtccctaagtccagggcaggctctggtccccacccacccgaggcagcagcatctagccctgctcctccctgcaccctctcacttctcagccatggacacacaggcccaggtacggttcttgttcattttggggatgtggagagccacgaacacaccaaagcctcctaggtgtctgctacagctctgacccacgcccggaccccagaccccagacccctgtccacctgagcgccaaaatctctgggtgccaggaagctttctgattctgccttcaaagtatttcctggaccattgcagtgggcacccacccctgggtctgccccagccctggtgttgccatctgttctcagcctggggctacagggaccccaagccctctgcttttggctcaaaccttgcacagcccattccccactgactgcccccctccactgctgtcacaattgctcgcactccctcatgctgttctggagctgttgaacatgccctctgggatcctgcccaccgccctcccggtccttaccttctttaggcctttgttcaaatctcccatcagcttggcgccccagggagccctctccatggtgtgcttgcccgaaacctaggtggaaggttcttcatcagagaaaccttggaagagcagcacaggagggtacatttaaagccctcagcggcgtccgttcctttgagggttctgggatctgaagcctctgaaccgtaggagcagctaggggaggccgtgcccctgtgtgaaggggctccttgtgccagccgacagggtgcgacggggtggtcggcccggctgccatcgtgggagggacgtggacaaacggcacgcagtgggaggccatgggcaaggttgatggcccatgggggcggcccctttgtctcttggggctacagcctgtgctgtgaccatccacaggccccaggggggtgctggcgggcatcagggaagtcccggtgacaaggggcatcagcaggggtcagaggggtgtgcccaggaggagcccctctgcattcttcagggtgcatggaacccacaccctgtccccaaagatgccctggacatgccctggggtggggggtggggggcagcacatgccaggctgccacatgtgtgtgtggcctcagggagtctgggctgggtcatcaggcatgaccattgccaaggccacatcctgactctaggcccctctggtctgggcagtgaggccaagcagagcacagggtctcgagaccccatgacctctagggtcacgcggaggctcctggggtcagactgagaaaggggctcgtcctgagaagccacaaagtgtgctcctgcgggggtgcggggtgggggaggtaccacgtctcccgggcagccacagatcccacactcacggcccaagtgacgcttggtgcagagctggaaggttctcagggtgggaggagggttatttttaacgcactgcactagagcatctctaaggccggtggttctggacagaaaaaccacaaaaatgagaagaccaggaatagcaagtccccagccctggggcctcatgtctgcaatgagcccttggtggctctgagcagtgccagttcagcaccttggagagctgccgcctctgtgccttcccttctgcttgctgcgtgggggcttgtggagcctgctaggaatcctgggaagagcccagatgggcctgccctcccagatggcctcttttgcctctggcgaagtgaagtgagcacctgtagtgaggtccattccaagcaccaggcccgggtgtctgtacagagcccgggtggggcatccaggcaccacggggaggcccccgccctggtctcacagacgttgccactggagctcctgccgtgcgcccactgccaccacctgtctgccacctgcacctcctcactgcggcagcactttctccacacaggttcttctctgatgcctcttccctaattttaaaggcattcaggtctcttacttagttaaaaaaaaaaaaaaaaaa

SEQ ID NO: 2727 - DNA, 1152 bp, Homo sapiens
  misc_feature (27)..(27): n equals a,t,g, or c
  misc_feature (29)..(29): n equals a,t,g, or c
ctccttcatgctttaacctgtcttggngncccagcatctgcctctacgtaggcactctctttaggaggctctgattctaagagaacagaatatttggaatgggcgtaatgagatattgagtgactttctcctttctgcaggactggatggtttccatgatcgtggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccayttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgstgtctcttttcctctctcagctccttggggctttccttagctctgcacctccttttcctttatcatctccttgggccatctcctccstctgtggtcatsattacacctccttgtttcctcctgtgctgagccctttccttgtgtccattccaccagacttttctaccctgagtgcgagataagaacgatgggtggaagagagcaacgccagagcccaggygcccagaggactttcttccagcttctgctgtgccttctttgtggagagcaagcaaatcgsrgtcttctccaggctgacaaggcgaagggcatggcttcgaagtgcaaaagagtcatcatgaaacatcatgaatcatgaatcattaggcgtcttcccttcgctccccacttttttttttttttttttgg

SEQ ID NO: 2728 - DNA, 1893 bp, Homo sapiens
  misc_feature (4)..(4): n equals a,t,g, or c
tccntacttcgtccctgacacccaggccttctgccaccatctcccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaaaaaaaaaaaaaaaacctgggggggggcccc

SEQ ID NO: 2729 - DNA, 2108 bp, Homo sapiens
  misc_feature (78)..(78): n equals a,t,g, or c
  misc_feature (219)..(219): n equals a,t,g, or c
aattcggcacgagaacccagaggttggcatcttcgtcagcattgcccagtctgagcaggagagcctgctgcagcagcncaggcacagttccgaatggcacaggaggaagctcgtcggaacaggctcatgagagacatggctcagctacgacttcagctcgaagtgtctcagctggagggcagcctgcagcagcccaaggcccaktcagccatgtctccntacytcgtccctgacacccaggccytctgccaccatctcccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggartgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaaaaaaaaaaaaaaaacctgggggggggcccc

SEQ ID NO: 2730 - DNA, 2266 bp, Homo sapiens
  misc_feature (85)..(85): n equals a,t,g, or c
tcacagcagtctgagcttatctgttttgtctttccctaccttgcccaccagtgatcgatggcctggatttgctgaagaaggaacnctccaggggcccgggatgggattcggtacctggaggcagagtttaaaaaaggaaacaggtacattcgctgccagaaagaggtgggaaagagctttgagcggacataagctgaagaggcaggatgcagatgcctggtaacattttagccctcacccctagaacctcaggccacctgccttgctcctccacgagcattcctagggagaacgggtagggctggataattctgaggctccacacgtagcctgccagggccctcctgcaggcctcaccttgcgaggagtacgaattgccgcagcacctgagcttttcctctgcagatgggtcagcctctttgggccttgcgatgctcaggcttggtgttttccctcaatgcacctttgcctgctccccatatgtctccagggccagcttccagggcccactgctgctcactgccctcccagcccccagtgcccctgtcccctggagatcctggtgtttgggctgtgctaatgctgggtcttggcccatcttcccctctgccccccatccccaggactctctataagatcctagacagctgcaaacagctgactctggcccaggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggartgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaaaaaaaaaaaaaaaaaaagtcgtwtcgatgtcgagcgatcatgatgaatg

SEQ ID NO: 2731 - DNA, 831 bp, Homo sapiens
  misc_feature (595)..(595): n equals a,t,g, or c
  misc_feature (602)..(602): n equals a,t,g, or c
  misc_feature (631)..(632): n equals a,t,g, or c
  misc_feature (644)..(644): n equals a,t,g, or c
  misc_feature (658)..(658): n equals a,t,g, or c
  misc_feature (688)..(688): n equals a,t,g, or c
  misc_feature (718)..(718): n equals a,t,g, or c
gagagagcagctggaacagagagtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgggccactctgctagagtccatccgccaagctgggggcatcggcaaggccaagctgcgcagcatgaaggagcgaaagctggagaagaagaagcaggaggagcaggagcaagtgagagccacgagccaaggtgggcacttgatgtcggatctcttcaacaagctggtcatgaggcgcaagggcatctctgggaaaggacctggggctggtgaggggcctggaggagcctttgcccgcgtgtcagacttcatccctcctctggcgccaccgcagcagccacaggcagaggaggacgaggacgactgggaatcctagggggctccatgacaccttcccccccagacccagacttgggccgttgctctgacatggacacagccaggacaanctgctcngacctgcttccctgggagggggtgacggnnccagcactgtgnggagaccagcttcnaggagcggaaggctggcttgaggccacacngctggggcggggacttctgtctgcctgtanttcatggggggacggctccacccagcctgcgccactgtgttcttctcttaagaggcttccagagaaaacggcacaccaatcaataaagaactgagcaaaaaaaaaaaaaaaaa

SEQ ID NO: 2732 - DNA, 972 bp, Homo sapiens
gccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccarccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaaaaaaaactcgag

SEQ ID NO: 2733 - DNA, 1695 bp, Homo sapiens
  misc_feature (1256)..(1256): n equals a,t,g, or c
gaattcggcacgagcatacgcagaaatggttaaattctgacttggaattccatgggaattagcaggctgtagacgaggttctggccgagaatgtcatggttggaccaagacttcccatggggctgctgtttgtggccagtttcttgtttttatttatccaatgtgtacatatgcccagaagctatttgtaatgggagtgttttaagaaattcataaatttaaaacactccacacatacaaaactctttctgaaatgtgacatcttaaaattattttctcaaagtgacataaawtaaaacagcgtaacagccatctctttgtaatatgctctcttatatttaatttttattaatcttcacctaaatactagataacatcatgaagagagcaaaataaactggccatctcagtttaaatggccaacagtcatcttttgatgtttatttctttgaaacaaaatgcaccctacattttattttggagcaaacagtcatcagaagtaatgtgaatttgtatgttttgmcaaaaagttttmcatatatgwtttaaaaggtgtttatgtawtatgaattamcttgtgtacaaaagagatmcagatttttcaaagagcaagcatctgaatgttaagaactgagttcattgaggttaaattgttctcaggaagtttaaggtaaaaaagaaagaaaaagattgtacttctcctatggcaggaagaggctcatttccagggtagagacttctgaaatccataaaatmcattccagatccaagacttcatgcatcatacctggacactgctgtcatagagagagwcttgtgagtggtttcctttcatttactgaatagagataaaaatgcccaaagcatatgtgagggrcaaattttaaaaattaatttaaaaattctgktctgkttaacactaataatctctaatgtatccaacttttcaattattgaaaatccaaaagtcaaatgkggagcaaaccttgaaacwtagagcagtaatgaatatctgctgccaatagcaaaatattcaccaaaattcaagcagaaggtgaatgtgactgaatgagaggtccttaagctttttcatgccatggaccctttggtagtctggctaacgtttctaataaaacaaaacaccggcttataaagaaaatcmatcwtatgraaatgaatrttgatcmcaatatttwaagraatwccmagtttgtgatgtagtaatatttgtgtctttattatgctataaaaggcangatgamcaggaggcttgatattgactcctttttgaagtaggatgagcataaatgatacattgaaatatctgcaaagttataatgtgatatgaaagtgtctgtaatttttattcctggcaatgtgatagaaactgctagtaatactgtggtttgttgaaagaaatgctacatttcagataagattagtgaaattgaagatataatttttttctattcaacttcatggaatctgaagaacgtaggttagaaagccctgatgtaaatgtacaatgcaaggtcatggccataaatgtatagtttcacatatttgcctttggtcaagattttgtctaatatcttggttattttagccagtgagtagtatttaccacatgggttttcactacaaagaggttaaaaataaaacagcaacaacaaaaaaaaaaaaaaaaaactcgta

SEQ ID NO: 2734 - DNA, 1320 bp, Homo sapiens
  misc_feature (490)..(490): n equals a,t,g, or c
  misc_feature (615)..(615): n equals a,t,g, or c
  misc_feature (1099)..(1099): n equals a,t,g, or c
  misc_feature (1115)..(1115): n equals a,t,g, or c
gtctgtccccagtaaccccggctcccctcctcccccacccgctggaaaccacgactccgccgcccacctctgcatttgactgctccaagtacctcaggaaatgacctcatgcggtctccgcacgttcgcgtccatcttgtttatttccagcgtttggcccgtgggagcgatgagcgcacctgttcagcccctgctttcagttctttcagggagttctcacgtggtcttcagaggttcccacacgctgcttcccacagcagctgcaccattgtacattccaacagcaacggacaagggctccaatctyttcgtattyttgcaaacatttactattttatgtggkkgttttttcttttctttttttttttttttttttgagacggagtctcgctctgtcgcccaggctggagtgcagtggtgcgatctcggctcactgcaagctccacatcccgggttcccgccattctcctgcctcagccgcccgagtagntgggactacaggcgcccgctaccacgcccggctaattttttgtatttttattagagacggggtttcaccgtattagccaggatggtctcgatctcctgacctcgtgatccamccgcctcggcctnccaaagtgctgggattacaggcgtgcgctactgcccggtttgaaaaggcaattgaggtttctaaactcctactaaaggaaataattcctagagttgggctgcctaagagcttacagagcgataatggctcacctttcacagcgacagttacccgaaacacatcttcagccctaggaattcagtgccgccttgactcggcacggaggccacagtctttggggaaagtagaaagagctaatcaaactctaaaaaggactcttgctaaactatgccaagagacatcagaaacctggaggtctttattacctgtagccttattacgggttcgaatggccctaagggaaatctgcatctcagcacttttgaaataatgtatagaaggcctttcttaactacagacctcctaatagacatagatactttcaagctacagaattatgtgatcaacttasgacaagtgcaaaacgcactccttgactatggnaatcagagactccctncccccactgaggaagacaatgtggttccaacccagctgggagactgggtcctattgcaaacttggaaggaaggatcctcagcagatcaactttccccccaagtggaggggactctatcaagttctccttagtaccccaactacagttaaacttctgggaataaacagctgggtccacttatctcaaattaaaaaaaaaaaaaaaa

SEQ ID NO: 2735 - DNA, 805 bp, Homo sapiens
ggaaaagtagtgaaactgttcacagatgggatgatcttatatgtagaaaaatctaaggaatctactataaaaaccagtaaactaataaataggttcaacaaaggttcagaatacaaggctaatattaaaaaatgagtagtatttctatagagtagcaatcaacaaaccaaaaattaagaaaacaattttatttataataggatcaaaaaaataaaatacttaggaacttaagtgtaaaacttatactctgagaattctaaaacatcattgaaagaaattaaaccctaaataaatgtaaagacatcccatgtctttgaatcagaaaattaatattgttaagataatgatagtcccattctgatctatagatcagccttacagattcaacacaatttctgtcataactctcagctgactactttgcacaaatggagtagctgatcctaaagttcatgtggaaatgcaggagacttggattaacaaaaacagtcttgaactaggccgggtacagtgactcatgcctgtaatcccagcactttgggaggctgaggcaggaagatcacttggcctcaggagtttgaggccagcctgggtaacatagtgagacccctgtctctataaaaaatttaaaaattaggcaagcctcgtgacacccacctatagtcccagctattcaagaggctgaggtgggagggtagcttgagcccaggagtttgaggctgcagtaacctgtgattgtgccactgcactccagcctgggtgacagcaagactctgtctcaaaaaaaaaaaaaaaaaaactcgag

SEQ ID NO: 2736 - DNA, 1538 bp, Homo sapiens
ggcacgagcccaggtaccttgtgacactggagtgtcatattagccctggactacccacctcctgacctcatgatccacccaccttggcctcccaaagtgctgggattacaggcatgagccaccgcgcccgccaccttgattattgtttaaataaaagatgaataaaagtacattcttatttttgattataatgtggcccaatgtatacatttcacttagtgtagcacatcacattgttcttactaaaactatttctagttttacaccagctcagatttttaaatattcattgctttttcctacttctgtctcaggcattgccattctcttcaaaacatatttgaaaaatgtccaggcttctcatctctgtgtaaaactgttcagtttgttccagtgtgacgagaaaaattggactgagcatacttttttgtgagacatccattttcttcctttgatgaatttgacaacttgtgacaattctcacattttggaacaagtctcctaattatagaagaagctaataatgataatataagaaattataaattatttgactgttttcaatttatccaaaaggaagtttatcaaactttctcctcctactttctgctccaccccacccctcagccccgatgcacacgctgtgccgtcacagcacttatgcctagagaattatgatccttaaatagcagtcaactcttcttaaatagcagtcagttgttctagcagtgtatcagttagacattctagaatatttcacaaaataagaattttgcagaaggaacattatagctccctaggtctagcaaatgagggaactagggtacagagaaattaagtgacttaagatctcacaacaaactagtggagtacttctacttaaatatatctctagatactcatagaaggtaaaagctacattgaaaattcacacaactcttctggaaagtggcaaattcaatgatgctgtaaagtctggcataatattctagtggtcaagacactttgggtagtaaatgagagaggccaaattcaaatcaggctaagaataaaaagaaatgttttctttcaagtgggtggagctcaagtaagtgtaaattccaggggataaattggattcaggcatagctggatgcaaaggctcaaaaatgtcatcagaatctgcctctttttctctcttggtgttgcttgccactgtgttgtcctcattctcaggtagcttgactcacacagctacaacaatggcttatatcctaatggttgatcagccacagggcagagtacacttttcctcagtggtccaagcaaaaatcctggggctcactcttactggctgacttggatcaggtgtccttctggagcacaacacagtgactccaggtggccaagcttgaatctcatgccacatccctaccaccagctccactaaaaagaaccacatggacagaaggggaggagtggttacaaagggaaaaataaatgtttattacccagggagggataatgaatgtaaggcaagcaaaaaaaaaaaaaaaaaa

SEQ ID NO: 2737 - DNA, 698 bp, Homo sapiens
gtaaggctttatcatctttacctctagatgaatagatgtgaaaaccatgtatagtatgtatgtatatgttagtgtgtatatgtgtctttatcttaaattcttacatttgttgtatctatctagtgctcagtatgttatatgatagtacaacatccaaaatggatcaagtgtgagaaatttatttcacatcaactttcagattgcaatgtttattcagtatttattaacacacatgggaaatattataaaattatgtctttttttagattctctttaaatgatattttcccttagaattctctgtggctcccatgaaattctaaggtataattaaagtcaaaaataagattggattctagttgcttttacccctaaatttaaaagtgatatttcaacactaaattctatactttacctaatttgattacaaagatgaaccacataatctcagcattagcctcaaaggcaaactcaatcataatagaaggaacacaagctttgatgagatctggatttcaggcttagtttggtcaaactgaattaactgagccttgtgacacacacctgtagtcttagctactccggtgactgaggcaagaggatcgcttgagcctagaaggtggagactagagtgagttgcgtttgtgccactgcacctcagcctgggtgacaaagtgagatcctatctcaaaggaaaa

SEQ ID NO: 2738 - DNA, 525 bp, Homo sapiens
ggcacgagatttttataatactatgctgaatctacaaatggaatactgggtaggttggctgggcacaggagatggctgcacctcctgcagagttaaccttggctgagcaagaggctccagggctgggcaccagatcaacctcatacccctaagtgagggcatcattaatgtctgtggcctgcaagtcgaggcatgcaggcagtcactgggtcaacatctgagcactcctggaccagaaccagtgcattccagaattcttgaattgaggatactaagacagggattcataatgccctctgcttgatgtgctggtggttgccaggaggcttggcttcagattcagaggaagataccaaaaaactgatcgtttccttgaattggcttttctatttacttcgtctgtgtctctcatattgaatatcctaagagagatgctggaatattttggcgttcctctagaagaagttttaccgattggagaaaaaaaaaaaaaaaaaaaaaaaaaaaaaaaaaaaaaaaaaaaaa

SEQ ID NO: 2739 - DNA, 861 bp, Homo sapiens
aattcggcacgagtgcaccccaacataccgtgtttaactcttctgtcttttgtttttgctgctatttatattttcatttgatatgttttataatgtttgtccctagagttgtcctttattgaatacaagggtcttttctcaattgctataatgtctgttataatccagatgtagatatttgaacaatgtgaatacacatctttatgtgtattatcttaagtgctgtttaatattaaagtgtatttaaaatgaccagatttcaaattagtgcagttttgagatatttgttacttaggtcttaccaggtatgcacctgtgttgtaatttatgttggtatgctttagatctggtgtttccttggttttttgctgccgtatctcaagtggctagatttgatatttccttatccctgatctgacatttttatgtgaccaagtttctgtagcattttgttgaacaccaggtactgttgccactgtgcctaaccctaccatctccactccatgctatctcttactttacatgtaaatgacagttattttagtcacttttcacaatgtgaaatgtttctaggacacttgtccatgaacaggagcaaattgaaatttgaaatgatcacatctgattgacttgtaattagaggatgtttgggtgtggttgaatgtattgtatctgtacttattgaaaaacctgaaagacctggactcactatgttttgttctgcaacctggttagtcagctacgtggaagtgaccagagagttgaaagccaatttatttatccctccaagatgaataaaacataaattactcttctagcaaaaaaaaaaaaaaaaaaaaaaaaaaaaaaaaaaaaaaaaaa

SEQ ID NO: 2740 - DNA, 571 bp, Homo sapiens
ggcacgagataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaaaaaaaaaaaaaa

SEQ ID NO: 2741 - DNA, 446 bp, Homo sapiens
ggcacgagaaaacatatacatttatttaatataagtttatgtggcatgaaaaccttcagaatttgtgaagacccaaagatgcagtttgtattgaccacttatataaggaattagacaaagagcagtaaattgcagaaatgtgatgaggtggggggtcgggggcttgggccagggcaggtgattggaggagaatggctgggaaggaagggccagtatagcaggtggtacaggtttccctcagcctcagcttctggtccttgcccataggaatcatgcctcccacctggccaagggaggacacctttcacatgggaatgtcatctcctgcttttcagaaacagaaggaaggtcagagtgatcttcttgtacctgctttttgtttttgtttttgtttttgtttttgacagagtgagactctgcctcaaaaaaaaaaaaaaaaaaaaaaa

SEQ ID NO: 2742 - DNA, 780 bp, Homo sapiens
ggctttttgaaataacttagacaaataatttcacacaataccagcataaacaagtataaacccgttcacattaaccaggcatccttagggaagattctaatggcctgaatggacatttcaattacatatatgttgatcatgtgtatttttctagtaagcactagtaccttacttgccctcccctgattaaacaaaaactgaaggtataaaacctgcccaaatggaaacctattttttcatagaaaacattgacaattatattttcatgttattctatctctgtttctaatgcatttttctcatattcataacaggggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataaggtaagaacatactctatcatgttaatgtaatattggaagctccaagtaagataatcggtgtgtgactttaggatattagattagaatatcatatctattgcagagaaagagatttacatattatgtttctacatgtgtgagtgccacatcagtaaatataagtcagtgtttctcaaataggtgctggcataaagatttaatgattaattttgctcatttcattttcaagttaaaatatcgaaaaaaaaaaaaaaaaaactcgag

SEQ ID NO: 2743 - DNA, 464 bp, Homo sapiens
cggcacgagctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttaaaaaaaaaaaaaaaaaaaaaaaaaaaaaaaaaaaaaaaaaaaaaaaaaaaaaaaa

SEQ ID NO: 2744 - DNA, 785 bp, Homo sapiens
gttttgttttaatctttgggggtaaaataatgcaataatgataaaacaaaattcaaaagcctgtaaagctatgggatctgcttgggattttcaagggtgagatagggtctataatagacatgtgtttactgattgtraccccaggcattggttttctgtscttcattgttaggataggtggatctggggacacagrctgrgtggagtggagaagaaaggatttattaataatcagggaggagcatgtgggatagatctgaggtatctgcaagcatttgagaactactgattgtaactatatgaactgaagatggctcagtgcaatcctgggtctttccacattccatatttaattaaaggcctttgccatatcttggttcctggctcaattttagtcagataaaatttaagttattataaaataataacaaatttggcatataaggttttaaactgatcacggtagctggacagcattagcaacaatagttgaaaaaatagagcttctttatgcagtgatatctgtataatctatttagctcaaagataacattgagtttatatccacgtatgtttatgaatgtgtaatttggacacctgggattttattgtatgtagatgttttatccgttccctttttaaaatccaatgttctatctgtaatgctctgccactacacattctttcaaaaaaattctgattctaaatctttaatgatgatatgcctcaatcttcttttaacatagatagctcttctggaaaaaaaaaaaaaaaaaaaactcgag

SEQ ID NO: 2745 - DNA, 410 bp, Homo sapiens
cggcacgagggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaa

SEQ ID NO: 2746 - DNA, 1304 bp, Homo sapiens
aaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcartktgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaaaaaaaaaagaataaaaaaaaaaaagtttgtcgac

SEQ ID NO: 2747 - DNA, 1248 bp, Homo sapiens
  misc_feature (607)..(607): n equals a,t,g, or c
ggtttgtcagacactgttttaggtatgaggaaatgacagtgagcaatacaaaggccacattctcatggagtaaaattccagaggtggagacatgtaattaatacttaaatataaaacagtagattttctaaacgcagaaaacggaagagtaacaagaaactaaatcaaggagcattatatagcctagactgcagagactcaatataataaagttggcgattcttcctaattatcaaatttactgcaattccagccaaaatgtttcagtggttttttttgtttgttgtttttgtttttgttttgccctttagcttcacaggtttgttctgaaatttatgaggtataaattcttaagagcagcaagaaaaatttcgaatctatttgtagaaactgcatatgatgatggttcataccagtagagagaaagattggatttgggggtattactagtagtaaggggattcactagtagtaagggaaatgcaaaataaaatcacattgaactagttcaaaatcatcacattggcaaaagcattagagtgccaattactggaaagatgtggagcaataggaacactcatacggtgctataggaagtagttgtgtntagcataatttggcaatgtctagtaaagttgaagatgtgaataatctttgacccagcaattccatgtttaaacctctacataktctctcctcgtgtttcaaggaratacatatgatggtccattgcagaactgtgagaatgagaagttgaaagcaatctaaccattaggttaaatacaagatagaatgcaaactaaaatgaataactagagatatttctgtcaacatgggtaaacctcaaaaatagtattaatgaaattgaactacagactattttatataatacagtataacgtacaatttcaaaacatgcaaattagtgttatgtatttttgtcatggctaaatactatataaaaaggatctaaaagaattaataaaataatcatcagattcagaacagtggtgacctgcagggagaaagacaactgagattggggaaaggatgcaaatgaaaatacctttaattattcatttcttttaaaaataagcaaatactgtatagccaattcttaaaatttgataaagctggctgtgagtatatgagtcagttcttactctctgtatctttctgtataaactatttcataatgcaaaaaaataaagaatatttaaatgaaaaaaaaaaaaaaaaaaaactcga

SEQ ID NO: 2748 - DNA, 914 bp, Homo sapiens
cgcgtccgggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcaaggcttggggtgggcctaatcctgctcctagggctgtgaatgttttcagggtggggggagggagatggagcctcctgtgtgtttggggggaaaggtgggtggggcctcccacttggccccggggttcaatggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2749 - DNA, 1122 bp, Homo sapiens
  misc_feature (63)..(63): n equals a,t,g, or c
tgaacagagcagtgagctgtgatggggctggggctggggcccaggaaggagcaggcaggagantttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtgaaaaaaaaaaaaaaaaagggcggccgc

SEQ ID NO: 2750 - DNA, 1041 bp, Homo sapiens
ggcacgagcgactccagactctcttacaattggcaataagacaagttaaattacatgagtgtctcaatccctttctgtaaacagggaagaaacagtaccaatatcatgaagtttcaagtatcaaatggagcatgcaatgtgtttatcacagtatctggtatacagcaatggtaattcctttcctcttttccttccaaattattgctccctgatcccatccttccaatgtggctcaattatcgggttctagtcattaaatgctactcttctacaataagccacataccaggtctgagaaagagtctggatcagacaagagttcagcactgtagtagaaaacagattctgggtatcagaggatctggtctcaagtcctgactgtattacctatagctctatgaatttaaccttgctgagccttaactgcctcatctctaaaatagacttaatacttattcctatctaatgggattgttatgagggttaattaagctaatagacttgaaatcatttagtgaactgtaatgtaacaataacaatcaccatcattagcttcctcctgggtcatttacagactccctatctggaagacttgacctgccagagatcaccaagtctcaatacttaggtgcaaaggggaacggctcaaagctaaaaagaaataaactagagacaaataaaattaaagcctacttaatgaactacccaggaccttttaacgttgaagagatggtacaggctaaagatataaacaaccttaactgagttgggctacattttcagatgaaagattcatgacagtagcgacagcgtttcaccatgttagcctgaccaacatggcaaaaccctgtctctgctaaaaatacaaaaattagccaggcgtggtggtgcacacctgtaatcccagctacttgggaggctgagacaggagaattgcttgaacccaagaggcagaggtcgcagcagtgagccgagatcacgccactgtattcagcctgggtgataagctgagactctgtctcaaaaaaaaaaaaaaaaaaa

SEQ ID NO: 2751 - DNA, 900 bp, Homo sapiens
aatctctaggaaggttattcttgagataaccaatgtatatactttggtgtgcagaagtgcttatatgtgctttccattgtatcatacagagtactaaaaagatgtgcactcaaggatcaagactaaataaaattaataactgtgactgcttcttcaaggacgttcttcagtgaattttaagaaaaactggctttttaaactgttgagtacatagtgatgaacaatgactgctaatacagctggtgccatggctttgattcatgcccagtctggggaactggaagctatcaaagccattctgacacctcgttggaatctatcacttgagggaggaacagtagccataagctcagtgaaaaggagtttgtgaataattcccctgaaaagtttctctctcaatttgagcagtcatagatgcgttgcttctttttgaacctgtgtcttattctaattgagttataaagaaacaacaatgaactgtggaactgaacagtccactctgtgacaagttcctctgtacaggttggtcattgtgtgacttttctaacttccattatggtccaaaaagggggttacaaaggtatgatggctgttgtcagatctacacagacaggccagargcatgtwattccctctctaggaacaaacatcagtcaccctcaggggttagggaacccagctgtcagctttggtaggaaaacgcaaccttctccagaacaaggaaaataagamcacccaccacgtcacattcttgaggtgtttgtgctgatccttctctttaatcttaacattgtggaatcwccacggctktgctaaacctagccccaarcccacwcyaccttactaccagacaaccttaaccaaaccatttacccactatttaaaaaaaaaaaaaaaaaa

SEQ ID NO: 2752 - DNA, 1536 bp, Homo sapiens
ttggatacttgctgctctactgctagactctcctcctctacaggagtcaggaatgaattcctggccattgcattaatccctttagacccaagcatgaattagctgacctgtggttatttccccttgccctggctgccaggctgctggcaaagtgaccatttgcccacttacatcctcattatgggaggtagagccctcccgatgcctgtgctgattccctccgtgtaagaaggatgcgtagttgttggtagtcccacgaggcaaatagctacactcctttgcctggctctctggattctgcctcttttgtttttaccctctctgtgcttatggctctacccttctccaccttccatttcgctcagtttggtttccttactctctctagaccatgtctttttcatttccatgtacttaccattagtcatgtgtgcctcttacctaaaagtgtgtccgtctttcatttccttcgtaaatttaggcaactatatgagtattcctgggttgttttggattgagtgagccttaagatatgacagctctagcacacagtaggtactcagaaaatgttagcctctgtgctggactgatttcatattttaccccaagtggttcatgtaactagggggagttttgcttcacactattaaatccactttaaagaattagtattcatgaagcacttagaactgtgcttggcacatagtaagcactatgtgtttgtaaaataaaacttctaccttatttgactttttaaaaattgtaatttatttttatgagaataatgcagctctggttttgttacctatctcaaaaacttacttataaatgggtacagtaataatttataaaaaagaaaatgactttacatgttgttcatatgtgtactttccaataaagtcttggaatatggtgacaatttagaaatatgtggggttctttttttaaaggttgtactgatgaactctcattaaaaggaactgctatattttgttgtttattgtagaatggaagctacaaaagtattcatgcaatggccaaagatatagatctcctcgcaaaaaatgccaaaacttataatgagcctggctctcaagtattcaaggttagttttgttgttgttgttgttgttgttttccttggtaatagtagataatttaaggtcagtaatttttataaaacaactttattgagatataattcacataccatggactttacccattaaaagtgtttaatttaggctgggcgcagtgctcacgcctgtaatcccggcactttgtgaggcctgggtgggtggatcgcgaggtcgggcgttccagaccggsctggccaacatggtgaggccccgtctttgctaaaagtgcaggaattggctgggcgtggtggcgggcgcctgtggtcccagccgatcgggaggctgaggtaggagagtcggttgagtccgggaggcggaggttgcagtgagctgagattgcactccagcccgggcgacagtgcaagactctgtctcaaaaaaaaaaaaaaaaaactcga

SEQ ID NO: 2753 - DNA, 1388 bp, Homo sapiens
ggcacgagattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctgggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgttatactcaatgaatttttttggcatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatataaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatgccagaaactgtataaactggatgttgcttaaaatctgtatcactgccatgttgaaaactcagactgcttttgtgatgtttcaaatgaataaaactatcctcccctcgttaaaaaaaaaaaaaaa

SEQ ID NO: 2754 - DNA, 1769 bp, Homo sapiens
gaaaaattaaagcacatgggtaatagcatgggcagagcagagactgagacgatctatgtccatgccaaaggaagcatcctagtaagtttctggctatggcaagatgacaaaactcggtgtacgttttatctggatcacttttggagcactaaagcagataaccaactttgtgctaacatacatgtgctcaggagagcctgattttaagactgacttcaccccattgctcttgtgttccagaaccttcaaggaacatcacctaccagatccaagctttgccagcttagctttcctcatgatcagctcctatctatctatcaatcaatcagctgtcagttccacccatgtgcccaagtgctcttcacaccttcacacctgcaatgstttcctgtgcagcctaccttggagktcccactcaatgctccacttccyttccagctcctttgaagactcagtcacacatgaatttggcatttamctttagtaatatmcycacaagtgtgttactagtgcctacctcaccttcaccagcctggagaaaaggctattttcagggtaccactgttgtgcagctgagccaagtcttcctgctctcaatcaatcaccctgctgctcttggctgccctgcatcacagccctctggatgatatgctcattgagggaggggccaactatatacaaaaaaaatacacgtttgctgaaattactcctagatttctagatgagtatgtaaatttttctgctcccaaagctctggcatctagtttgagtcaatctgagctctataacaggtgaagacatcatattagtttgcagactagactatcaataggagaaataggacgaaagcagcactttaaaaatggatattaaactaccacgatcttgagcaaacatctttatttaagaaatcaaatagggtaaaaattatgcaatttcacacaaggatacaagacaaagcttagaattacttgctcaaaagttactcagaatggaacaaaattgttcaagtgctcccaattagcacaggctgtattacttgcttttcaatggacatttactattttacattaagatctacttataggaacaaagagacaattcccagccccctctggtgtatcacctaaaagactgaatacaaatgttaatgtaatccaagcttttctttgacaacaatactaaaaattgccttacaattttttacaagtacgagtatcaacagtttactgtctgagggaaaggaaatataagaatataaagtgacagaagcaacacacttcactgtggcctgcaactgctcccagcstcctattttataaacatgatttgggttctcacattatagcaggatcactattcctagcctctggtggaagcagacatgtgacacttagcactgcacaagtgtttctttggcttcttgagtagtgctgtgtatactgcctatacatttttataacatctctaaatgcataatgtcaacgtatgtgctatcacatttcactcccaactgcagaatattttaattttaaatttatctaccaaatcttgactatgacatttatttttgggttgttacattaagatcaacctatctgggccgggcacggtggctcacacctgtaatcccagcactttgggaggctgaggcaggagaattgcttgaagtcaggaggcagaggttacggtgaaacaactgccattgcactccagcctggacaacagagcgaaactccatctcaaaaaaaaaaaaaaaaaaactcgag

SEQ ID NO: 2755 - DNA, 1502 bp, Homo sapiens
  misc_feature (806)..(806): n equals a,t,g, or c
  misc_feature (860)..(860): n equals a,t,g, or c
ggtttattttaaatttttaagtggtgtagccttttaacaaactatgtgtttccataaacttctgaaaaatttaaccttgtatggaaggcaaggcaggaatttttaaaaataaactttattttttggagttgtggatttgcaggaaaattgagaagatggcaaagaaagttcctgtatacctgatgcccagtttcccgtgttgctaatatcgtaggttggtatgggatctttgtttcgattagtgaaccaatattgatacattaaataaaagttcatatagtaagtcctcatttaagtcacagatagttcttagaaacccagagtttaagtgaaagaacgtctaaacatgccaaatttactatagactgattgataggaacaagagttaagttcctatggcaaatttctggttacagaaatatcacccagcttctaaataaagaacaaaacacttctaatattaaccactgaaataaataggagctatacatacatttcagaaagattaataaaaatcaataagataattactcagttattccagttcagggcggtggccagagcccatcctggcatcttggagcgcagggcaggaacagccctggacaggatgccctcccattgcaggtgacacacacgcacactcaatctgggaccatgcagacatgccagcttccctaatgggcacagctttggagtgtgggagctcgctggactacctggagaaacccatgcaaatacgtgggagaacatgcaaactccacacagacagtggcttgggctggggatctatttttttttttttncattctcgtcaatgctgtaatcaaatgatgctgaacaaaatgatgttatctganaacctactgtactttattcagatctcctcagttttcatctgcagtcccttttgagttccaggatcctgtctagcataccacattaggttttgtgatcacatctgactcctcttggctgtgacaattgtcaactttccttgtgtcgatgaccttggcagtttgaggtgtgctcgtcgggtattttgtaaagtgtctctcagtcgagattcgtctgatgccctctcatgttaagtctagggtgatgagtttgggaggagaccacataggtaaagtgccgttctcattacatcacatcaaggtacatactgtcaaaatgacttatcatctccatactgacattgattacctggctgaaataggggttgtcagctttctccactgtaaagttgttcttttccgtaataaaggattatggtctttattactgttctcttggaaggaagccactgtgtggaccccacacttcagaagtaaggaattatactccacctccttgggtgtgaagtatacacataaattatttggaattattctgcttaggagatttgtctcatcccccttaccacgctactcctacctatctccccttttatactaataatcttataaaaaaaaaaaaaaaaaaaaaaaaaaaaaaaaaaa

SEQ ID NO: 2756 - DNA, 2199 bp, Homo sapiens
  misc_feature (2143)..(2143): n equals a,t,g, or c
  misc_feature (2154)..(2154): n equals a,t,g, or c
  misc_feature (2159)..(2159): n equals a,t,g, or c
gcttactgtatggacaggttatatggaatggagtttgtagtatccacattaacaaagcaagtttatatggactggtatgatattagggatatgaattagaaatggatgttgttgcactcatttaaaatattttgcctctcactttatccccagttatagtgtccttttgaatttttctcacacagtgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaawtttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagktctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtgggaatcaaacataccatggaccccaatttatccaagttctaacacattagtagraatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaaaaaaaaaaaaaccgaggggggccgnaccatcgccanaggancgatacatccggcgcgttacacgcggactggaacctgcta

SEQ ID NO: 2757 - DNA, 1385 bp, Homo sapiens
ggcacgagttatggtttaactcagcagaatttgttgaacaactacgacatgctggggatcatggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacgcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaaaaaa

SEQ ID NO: 2758 - DNA, 3787 bp, Homo sapiens
aattcccgggtcgacccacgcgtccggcattacctggtagtaataaaaataaataggtctaagccagaggccacaggttggaaatcttctgatattgcagcatgacatttctgacctggaaagatctatagaatgcaggcttcaccttgttaatttattgatgcacagacagaggcatgaaggggaggtgctttgtcagggccaacatcaatggccacaccagggctggaacccaggctcaccgactcccaggccactgtgcttggctctgccctctccctgaaccagccttagcacctcaaggcgggagttgatggtcctcattcccttccctctgtgtctccttacagcctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgacaaggccggcaattaaccctcactaaagggaacaaaagctggagcccaccgcggtggcggccgctagaactagtggatcccccgggctccagggattcggcacgagggacttatgcaagctcaagcgcaccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgaggctggaccaggtgtctccccacgcttaccttaaggggctcctcttatctccccttcacacgattccttctgtgccctggccccaggtattattctgaggctgccttggatggcctcaggccaggtaaccccaggctgaaggggccctgctccccatcccctaccatgggcacccatgtgctggcacagaacagttcgagatctagactggagaggtccacagccttgtccagagttcctgtgtagcacggggagcagtgatggagggagcccctgagagggaatctggtgagggaatccagactcccttctctcaaggggaggctcaacagaacattgacctgggggcaaactttcctcttgaatgggaaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatcttcctggacacctgccattgttgtgaagccagacagtgacctcaaatggtgccttggagtcccctacagcccctcagcagacggcagcacttgaatgcttagctccatcccatagttctctacttcatataaattgctcaagcccttccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttgggccctttggcccttccctgtgtttctcactttccaacctaatccctggctcagggttattgccagtggagaactggtgagctggggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcagggccagggaacaggggagggctccacaagcgtgtctggcattcccacccaccatgggaagactggatacgcacctggaaacaaaaggactatggaagctgttcaagatacatttgatcttcagaaaagcagaatttggttcaactgttgacagaggacacaaatacgttgttccagagctcaaccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctaaaaaaaaaaaaaaaaaaa

SEQ ID NO: 2759 - DNA, 1705 bp, Homo sapiens
  misc_feature (170)..(170): n equals a,t,g, or c
atggggaccagcgggggccctgagcacttcccatctttggcacaagcccctgttcctagctcaccccagacttgctgatccccccatccctgcacgggccttggtcttggccatttctccaggttccctgagtggggaatggtgctgagaccctcctttgagtgattgtnttggacagtttttgttttcttgctgtctgtttarastartggttctcaaaccctgcttgggccatcccactggggarctgggacaccacctggcactgtggtggcagtgggggtgacactcagacaagggccatcgagggcccctggaccagaaagcgaagagggcgttgggggcaggaggcctgtggggccatgtgtgggggccgtctgggtggcgggagctgttggggcggggctgagcgccctcagcagcccactggagaaagcgctgctggggtcctcgtgtggggcccagggcccgacgtggaagcaatggagggctgcagggggtggcagtggggatgaatgagtaaggacagagtgcagcctgggtctcagacggggggtgggggacaggccacagagattccctatctcagcagagaggagacaggctcaggctgccacgccttgccaaaacccagcctggccaggccagcccggcaccttccacctagataagttgtgctgctccagagaaagagcctggggtcagagtggacctgcgatgcatggcacaacctgctggacagtggcgatgaggggttcagggacctgggcacccagaagcgggcacctgatattgtacccagcaaaactgctcctaataatgtcattttttctctctcttacaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtytttactgcttggaggtggctgagttgggggccctgggcaggggtaagctggcaggcagtgccatggcaggccagggtcccctcccatggggtctggcccccgttccagcatgtccagcccctgaagttggagtkgggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagaaaaaaaaaaaaaaaaaaaaagggcggccgctcgcgatctagaactagtc

SEQ ID NO: 2760 - DNA, 1067 bp, Homo sapiens
ccacgcgtccggtctactccaccgtcatcgacgtggagtagaggtcccgcagttgatgattttggtcttcttgtcccggttctcgtggaggaccgcgtttgcgcagatgaagaggaagatgccgatgcccatgatgaggggcccgaagaccttgagcttgtcagagtgcaggtagccagagaagatgcggaagaagaagcccacggacgtggaggaggaggacggggaggcggctcgtgctggaggcgtgctcctgggcgcgcccgcggaactggagttgacaccccctggagccctagggtggctcctggaccggtttttgctgccactgctactgctgttggccgtggttgggacccggtggctgctgcccgcagcggcagctgcttacccccctcccgattggtcccggtggccttgggccagtagcccaccaccgccatggctatgcccaccagcagcaccaggatcccacagagggcgatgagccctgagatggagcacagcttcagcttgcctttcaacaacaccacgtcgttcttgcgcctcttcttggctttccgcttgcgcttgggtatctggcttggggggcggagtggatcctgctttctggcggaaatccttagcaggccgcggtggcgatcatggcgagctcctggagtgcaggactagcctctgggatggaggcttgcacagggagggcgccaactgcccactagctgctcagccacctcctcctgccagggagaccgagggaggtcggggccggcgaacgggcgctcgggcgacacaaaggaaccatggagaaactttttcagcccgagccgacggcggagcgcagggacagcgccccggggccccgcatccgagcgcggctcagcagccccgcgggggcgagcgccgccccaggctcgcagtccccgccggcgctgtggcgggagccatttccaagagtttccaagaagtgtcaggtcctccgcatcccgcatcccgcctcggagccctcctctccgccgctcatctccggctcccggcgtcccctagcgcggcgctcccgggcgggccct

SEQ ID NO: 2761 - DNA, 2270 bp, Homo sapiens
aattcggcccgagtgcgcctgcacgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaaaaaaaaaaaaaaaaaaaactcgggggggg

SEQ ID NO: 2762 - DNA, 778 bp, Homo sapiens
ccacgcgtccgcccacgcgtccgtctagatcgcgagcggcagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataaaaaaaaaaaaaaaa

SEQ ID NO: 2763 - DNA, 3268 bp, Homo sapiens
cccgggtcgacccacgcgtccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaagccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgcctggagggcctggctacagaaggggaacctgaggcccagaaagaagggactcgccaaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgccccagcaccaccagtgaggtggttaagatcctggagcgctggtgggggaccaagcggatcgactactcgctgtactgccccgaggcgctcaccgctttcccaccgtcacgctgcccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtttgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcaccccaaaaaaaaaaaaaaaaaaaaaaaaaaaaaaaaaaaaaaaaaaaaaaaaaaaaaaaaaagggcggccgctctagagga

SEQ ID NO: 2764 - DNA, 3350 bp, Homo sapiens
tctagctgtagtcgggctgcttgtcggcttggctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaatggcatsagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcarctcggtgccmmcttcccccagcttckcrsygcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggggggckcmtgcacccgcaccacgccgccgggccttgcacttcgacgaccgcttctccgacgagcagctggtgaccatgtctgtgcgcgactgaaccggcagctgcgcggggtcagcaaggaggaggtgatccggctgaagcagaagaggcggaccctgaaaaaccgcggctatgccmagtcctgccgcttcaagagggtgcagcagagacacgtccttggagtcggagaagaaccagctgctgcagcaagtcgaccacctcaagcaggagaaatacgagaagttggtgagmagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggcccctacacacacacaaacccgcacgcacacaccacacacacacacacacacacacacacacacacaccccacaccctgctygagtttgtggtggtggtggctgttttaaactggggrgggaatgggtgtctggctcatggattgccaatctgaaattctccataacttgctagcttgttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatsctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgaaaaaaaaaaaaaaaaaaaactcgaggggggcccggtacccaawtcgccctagtgatcgta

SEQ ID NO: 2765 - DNA, 3054 bp, Homo sapiens
  misc_feature (3040)..(3040): n equals a,t,g, or c
ggcacgaggtctccagcaccatgtctggtttgtctggcccaccagcccggcgcggcccttttccgttagcgttgcctgcgcagcacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggstaccactgktctgtccyccatctctgtaattttgtcatttcaagaatgttgtatgaatggaatcatacagaatgtaatcttacraggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagtyatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatycaagtagagaaaataatatgtgggttaagatacatccttaaactttttttttttggggggggggggacggagcttgctgnacgcccagctggag

SEQ ID NO: 2766 - DNA, 1029 bp, Homo sapiens
cccgggcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgtagattagttttgcctgttctagaattttatgtatgtaagtggaatgatgtactatgtatgtttgtgtttggcttatttttaccagcaagtttttgaggttcatgttattgtgtgtatcagaagttagtttctatttattgctcagtagtattcatctgtgaattaccatggtctgttaatatatccatctattgatgatgaacatttagattacttttagttttgcctattaaaaataaagttagtatgaatatgcatgtacaagttgtattgtggatatactttgtgataataactagaaccaggagtggttcaaaatttaatttacacatctactccctgtgttatttgcctgctcttagtgtgccaaatgttatttagtacatttgaaaggatgaatctcagtatagactgagtttgtattgtggtccccaatgtttagatcatatatctgtatacctatctctgcgatgattttcatcatcatttcagtaactcagatttaccaagttcttattctgtatcaggtgataattgtaatccctgtatgtcttatgtcacttaaactatacaactgaggtgggttctatccccatgttgcagtgaggaagctaaagtacaaactagctgttaagtggtagagacagaattcttgattggatttctgatcctgcacatataatttaacttgtaattatgatatctcttgatatttatactattatgtaaaagtgcttctgtaaaaaattaaatttgaaatttcaaaaaaaaaaaaaaaaaaaaa

SEQ ID NO: 2767 - DNA, 2319 bp, Homo sapiens
  misc_feature (121)..(121): n equals a,t,g, or c
gcggcaagaagacgccatggggcaagcgtggctggaagatgttccacaccttactgcgagggatggttctctacttcctgaagggagaagaccactgtctggagggggagagcttggtggngcagatggtggatgagcccgtgggggtgcaccactcgctggccacccccgtcacgcattacaccaagaagcccacgtmttccagctgcgcacggctgactggcgcctctacctcttccaggcacccactgccaaggagatgagctcctggatcgcgcgcatcaacttggctgcggccacscactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcragctggaggagcaccgcctgcggaaggagtacctggagtacgagaaaacccgctacgagacctacgtgcagtgctggtggcccgcctgcactgcccctctgatgctctggacctgtgggaggagcagctggggarggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaaccagcaccacctcagagacactgttccctgctccaggktagacctgagatgaacctccctggaggagacttatttcaatgagtccaccatgacggatgaggcacytcctttccctgctgaargacaaaccttgtttccctgtggccctcattcttgtgctcctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtragggctgggcggggtggggcctccagagctttgcagggaaccctggaaccctaggaacaaggagcctttgttccaacagagcagagcaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaaaaaaaaaaaaaaaaaaaaaaactcgag

SEQ ID NO: 2768 - DNA, 2331 bp, Homo sapiens
  misc_feature (121)..(121): n equals a,t,g, or c
gcggcaagaagacgccatggggcaagcgtggctggaagatgttccacaccttactgcgagggatggttctctacttcctgaagggagaagaccactgtctggagggggagagcttggtggngcagatggtggatgagcccgtgggggtgcaccactcgctggccacccccgtcacgcattacaccaagaagcccacgtmttccagctgcgcacggctgactggcgcctctacctcttccaggcacccactgccaaggagatgagctcctggatcgcgcgcatcaacttggctgcggccacscactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgkttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtragggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccsgccagggcctagggctaggccatgcacccaatgggtgcacaataaataacaggtcaacaaaaaaaaaaaaaaaaaagaaaaaaaaaaaaaaaagtcgac

SEQ ID NO: 2769 - DNA, 2331 bp, Homo sapiens
  misc_feature (121)..(121): n equals a,t,g, or c
gcggcaagaagacgccatggggcaagcgtggctggaagatgttccacaccttactgcgagggatggttctctacttcctgaagggagaagaccactgtctggagggggagagcttggtggngcagatggtggatgagcccgtgggggtgcaccactcgctggccacccccgtcacgcattacaccaagaagcccacgtmttccagctgcgcacggctgactggcgcctctacctcttccmggcasccactgccaaggagatgagctcctggatcgcgcgcatcaacttggctgcggccacccactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtragggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaaaaaaaaaaaaaaaaraaaaaaaaaaaaaaaagtcgac

SEQ ID NO: 2770 - DNA, 643 bp, Homo sapiens
aattccccggggctctgagggccctccagacctgctcgggtgctggggccatgccgagtcgcggccctgctcagccggaagaggctcccggacctggatgtacagggcagtctctcttcccggggctatgggctgggcctgtcctgccgtcatggccccctgcttcctgctccttggagctggctcccggactttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaaaaaaaaaaaa

SEQ ID NO: 2771 - DNA, 1620 bp, Homo sapiens
ggcacgagggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatgggcaccttgtccaccctgtcgtgattattccagtgagatgttactgttctgctctgaagaagatactgtcagacgaatcctgcatttccttcagctggcatgcatgcctttggactcaatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgtgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctaaaaaaaaaaaaaaaaaa

SEQ ID NO: 2772 - DNA, 1095 bp, Homo sapiens
ggcaaagaccaagatttttgtcgtgtagtcaggctcatcatgcctgcctccttcttccctttggagaattctgagggatattcctcaatctctcagaatcaaaatcttaagtgtctaaacttccaaatgactgcagcttttctcaagttaagaagccaaactaaaataggttaccatcctcttttttttaggaaagagtttatgagtgtcacaagtgcctggtgtggagtttggattatttataggattattaaatgactctctgaggcacaggtgaatacataatttttttgagggagattgcctaatgaacatttgtgcggtaaatattaagtaagcactgtttcatgtgccagggataaaagattaaagatagttcttccatctggggaggagatagcaaaacacatggacaattaaaatatggcctaattaaatactgtgataattataaatatcaggtgctcagaagtttgtaggaaggcctttgggggagaagagcaaagggtaggcaggtgctgttcaagttgttttagaaaagggaaccctgatgagtttaggatacagttggccctccatatccgtgagttttgcatttgtggattcaaccaaccgagattggaaaataagttaggcccatgatcgttgtgcctgtgctgaacaggtacagacatttttcttgctagtattccctaaacaatacagtatagcaactctttacatagcatttccactgtattaggtattaataaataatctagagtaatgatttaaagcatacaagggccaggtgtggtggctcgtgcctgtaatcccaaaacattgggggctgaagtggatcctcaaactcctggctgcttgagcccaggagtttgagaccagcctgggcaacatggtgaaaccctatctctacaaaaaagtacaaaaatcagcagggtgtggtggtgcatgccagctactcaggaggctgagatgagaggatcgcatgagcccaggaggttgaggctgcagtgagctgtgatcgtgccactgcacttcagcctgggcaacacagtgagaccctgtctgaaaaaaaaaaaaaaaaaaaaactcgag

SEQ ID NO: 2773 - DNA, 2458 bp, Homo sapiens
  misc_feature (1092)..(1092): n equals a,t,g, or c
gggagtgaaggcctggttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgctgggtgctgggcctgccctctccggccgcttgctgcctgtctgctttccttggtggctttgcntgggtgctgggcctgccttctctggctgcttgctgcctgtctgctttccttggtggctttggcttctgcactccttggcgtcasctytcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaaaaaaaaaaaaaaaaaaaaaaaaagggcggcc

SEQ ID NO: 2774 - DNA, 1127 bp, Homo sapiens
ggcacgaggggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccggaaaaaaaaaaaaaaaaa

SEQ ID NO: 2775 - DNA, 378 bp, Homo sapiens
ggcacgaggcaaaatcagagaggggtgcaagatcctgatttttcaggcagagagaggagaattcagccacctgaagtcagcacctacagaagcacagtctcctggctttgcctctgaattattaacagcagagcagcattaaagagcccacacactagaaggaggatatgaagaaacacccagagaatgtcacaaaaacccagaatgtcacagtattgttttcttcttgctggtgtcctatcctctctcctaacaccagccaccaaagctgatttttaaaaaatgccatgatttctcttgtttacaagaagctgtttcctataccctattcttgaaggataaagaaatagtcattcaaaaaaaaaaaaaaaaaaaaaa

SEQ ID NO: 2776 - DNA, 2056 bp, Homo sapiens
tcgcgagaatcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaaggatttatcatccaatattaacagtaaggagctttgttcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaacccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgtaacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaaaa

SEQ ID NO: 2777 - DNA, 2366 bp, Homo sapiens
tttcaatcaatttatactgagtgtattaggatttctgctattaaatgcgtgatccctcttctgcttcagtttctggcttggctttgtctgtttcaaaatatgtagcttcctctttggcacaacaaaaaactcattttcacttttattaaatatacggtgttatcattgattttattttctcttatgtatctgtaaagatttttggcacataaatgtaatataaagtcagtggatgctataacttgcaatgtttgcatcatgtccaccttttttaaggagtgaaaaagccctagtatgtttttaaagaatagccagtgcaagctcagtactagagtgactacacacactgcatgttttcatatgtgggcactttgatgtaccgtgttgggttattgttctagattggactgttaaatactatgttcaaggctgggttgtcatttttataaaggtcttggtgttttatggccattagttattacttttgatatagagaatgagctacgtgcatttctaaagccaataaggaggatgtatttaatgtgccttgtttttgaaactgaataaggaaccggtaagcatggaatcaatgaagaacctgattaaaatggtcaaaaaaaaaaaaaaaaaaaagtggtgaagtatttatgttttcctttaaaacacatgcagaacacatatacgcatgcttgcgtgcacgcacacacacaacttacacacacgactctcacacacacacacacaccagccaaacagtccacctaaatggcgctgtggtggtgagagctctgggcaatggaatcttaccaaacgtgcagtgctctgttttggagacagggacaccctttttgtttatttcagatataaaacaatgcaggctttgtcctgaatatcattatccaaacaagaaaagggaacataccttctcaaataggagaccttcctggcctatgatgaaactttgggcctgactctggcatgcacagccttgttctactctgtcctctctgttctgatccttgtggagtttgtgtggcaccaaaacactcccatagtcaaggccagcaaccagactctgagctacaccctccttgtctccctcacactctgctttctctcttcctcgctcttcatcggccgccccagccctgccacctgcctcctctcacagaccacctttgcagctgtgttcacagtggctgtgttttctgcagggccttccaggctataaggccagaaagcaggatccgaaagtggatgggtccccaaaaaacaaattctgttgtcttcctttgctcctttacccaagtgaccctctgtggaatctggctggggacagagcctcccttcgtaaacaaggaccctcagttcatgcctggctacatcattatccagtgtaatgagggctccgtcactgccttctactctgtcttgggctacttgggcttcttggttttagggtcccttgctgtagcctttctggcaaggaacctgcctgatgctttcaacgaagccaagttcctgaccttcagcatgctggtgtcctgcagtgtctgggtggccttcctcccgagttactaaagcacccagggcaaggccagagtggccgtgagatcttctccatcgtgggctccagcactgggttacttggctgcatctttgctcccaagtgctatgtgatcctccttcatctagaaaggaacactattcaatgtttaaagaagcctagtccaggcatggtggctcacacctgtaatcccagcactctggaggccaaggcggctggatcgcttgagcccaggagttcgagaccagcctgggcaatgtggcaaaaccccatctctacaaaatatacagaaattagctgcaggtggtggcatgcgcctgtagtccccagctactcaggtggcggaggtgggaggattgcttaagccccaggaggtcaaggctacagtgagcccaagatcacaccactgcactctagcctggaaaacagagcatgactctgtctaaataaataaataagaagcctgagaaaccataaacagaccaaacaataaacaggctgagaagaggaattgtaatgatcattagtggcagagaatttgtaacctgattgtggaaagcacatctgaaaacaaagattgaatgaactatttgaaaaaaatggcaatgaaagaaaatttacagaggcaaaacctgaatatccagtgaataataaaaagattctggctggctcaaaggtagtgagttctaccaatgtattgtccacagtcagttacagaccaaattccttgttctactctttcccccctcctcactaatgcacttgactagtctttaacgaagaaaaaaaaaaaaaaaaa

SEQ ID NO: 2778 - DNA, 2761 bp, Homo sapiens
cacgagtgaccttcaaaattgcttccacttctaattttgttttaagacactattgactacacttctcctaaaaattgatctttttgacgtgattgggctcttgagacttttttaccctttgtcctgatctgattctctccatgaatcaattttgttcatctcatctgtcactcttcctctgtatgctttgtaacctgcatttcctctacttctggcacttttttgccaatggaacctgcaattctactctgcaaatagctagggttgtttcctccctcactcccagccaaaatacagcttttatagtagtatctctgagtagggagttgggctattgaaaaaacatgctatagcccaaagtccctattttaaaagagatagagattggaatgatatgttctttttagggtgtggatgttttaggctccaatgaccataatcaaaatagatctataaccaagccgtaaaagggtaatatatgtgaattttctcataatatgaatcctaacacaaaagcagttacaatactttaagcgtaaattacatagtctgcaccatgattttttcaaaatttgtcttacgaacctcaaggaggaaaatgtaccccactggttaggaaagaattattttctctaggttccataacatagaaggagtgttttatttcctcactgccttgtgcctgggaatactgaaatgatagattcagccatgttttaataaaattcctctgtaagaatattagcatggagagagattggtataaatacatgaatgtgcctggattttgaaggtaaatcctatagctatcagattgctattcacttaattgccacaatctaaaatttatctgttagtgtttcttttctaattgttactagtgtgataaaaagaaaaactcttatttatatatagattatttgtttcaggacattaactgagaatatagtattgaaatgacttgaaattgaaggaatcagattttctactgcttatttattcagaatataacttacccaacaaggtctgatttaatttattttgaggagtagtatttagaagcaggattactcttatttaggaaaagaatctggatcttagatatacagtgacttgcccagagtcacctagtaaatgaaagaactataagtcaccacttgggcgtgtgattcatgatcttgactatgaattgataccagtactttacatgaaatggccatactctgaaaattatatttttagatataaccttaataaatatacttgcctttcacagaatattagaaccaattcctccttatcttcatggaggagcatacttaatgatatatgtactgatgagatttcgtcttatttttaaaaacttccaagaaagaatgtttcatagctcccttcattcatctactctggtgcttaattagatttgatacgagaacgctttctttcttatctaacttgaatccctcatgctgtagcttaagtctggtttctctcactctgcctaaggatgccaaaagcagctaatcaccattatccatagtaatattcacaaagtcctccttatgtttgaaatgttagcgctataactgacagtaaacataacccccaagtatcagcaaattataaactagagaagagggactagcttgtagtaaatatagatgacatattagtatttagttgtgatgaatgaataacactaaataacgtgacttaagcattaagcagactaaatgaaaggcattcttctggtaactcattcacttaaatatttattaggcacctactttgtgatgctatgctacattcaagactttcaatgaaaatgatttttaaaaagtaaaacttattaagtatatttctcaaaatgtgaatgtacaatagcctaatattaacaagataaccctgtgccttatctaatcatcctgtggaatttacccatattttggaggtggggctgaaaaatagtctgattattagaacatttgtgtttatatttacagctgccctattactaaaatatgcagttggcatcaaaattttaccatacacagtcactgagcccttcacctggaagcctctttatttcagcattactgctgaagagttacctgtgtctttctgtgtgcatttgaacatgtgtgagcatgcagccagtgtagcactacaagatgcttatcgctagaaataaattatagagtcgtgcagcatgaaaattatatgcccgggaatgcagaacacagggttaccttctgcctcctttctttgtcatggacagcagaggcagaaaggagaaagagatttattctaaagccatttgaagctgaccaagcaatttataacagatgaaatgctgatttattgctgcagagaaaataatgggtgttcttgctaaaatgccattaatagctttattgtttaaagtgcaaattatattcagcaatttgttagtcctcttttgaggcaaagttgaagtaattcaatgtaggcttttagcagaaaaaaggacaaagtaattaacaaatcgtaaaagaattcattcaccaagattggctgatagttgaattctctgtctgaactataaagacatagggaaaatttgcacttaagaaatacaagatgactcaagtatttgtttaaaactgaaaagccataaggaagttggagttgggacactacagatttaggagtatgccttctgttggtgtccactgtgtctgcaagatgtggtagtcaaccagagaaaaaaaaaaaaaaaaaa

SEQ ID NO: 2779 - DNA, 1601 bp, Homo sapiens
  misc_feature (22)..(22): n equals a,t,g, or c
ggtcacgagctgggcctcccgnaaggtaaaactattttaaagtgtacagttcagtggcaataagtatattcatgatgttgtgcaactgttaccactattggaattccagaacattttcatcaccccaaagagaaaccccacaaccatcaggaaccagtcctcattctcccctttcctcagcccctggcgatctctaacctactttttgtttgttttccaattctggacatttcctgtaaatgggatctaataatatgtggccttttgtgtctgcttctttcactaaggaaaaatgatttgcattttactcttgcatgttctgtgttgtttgtgtgggcgtattcatctaggagaaatcttcctgaagttccttctgtaactaattctgcactgtccatggagtcatgttattgtcagactggtggccttagagacatgctgttttctgcaacatcgtgacacaaaagggtgcaccctgtaagaatcatttgggaatttttgttctcttttcacaaacactacatctcaaatttttaatttgatcaaatttgactctcggtgtctgcaattttctttagaaattaagctaacaaacattatgacattgtaatattgtgaaccatgataaaatcttaaatagtgacaaatgaagcatgtgataacacaatattttctactttttacataatgcagagatggcaaaattacacatttaaaataagtagatatatttttccatccattaaatggttctaatttgcttactgcttctgcctgtatttacttccaaaccaggtatctgcgagcttttcctgcggstactttggaacagaagaagccatagtaacatagaggtgaaaaaggggtaaaaggtttcaggagcacctaggatttcagscccagtgagaaatcacttcamccaaattgcagcaggggagctggtctcaggttgggaggagagaggggagacttattycatgatcttttctctattycccatacagggaagagatagtattttattattttttatgkattattttgkatttacttatttatttattaaaatagagacsggggtctcaatattttgcttaggctgatctaaaactcccgagctcaagccaccctcctgccccagcctcctgaataggtgggattacagatgtgtaccaccactcctggcactgggaagatattttaatatgttttagaccaatttagaaaatgaagctaaaagaggtcatctaagggaaatcgtttcctaacattttgatcccgcatgcctatcagcagagaatgttttgagcatgtactcctaatgtgtgtacatttatttaaacattctatgatgkaaaattcttaatttgtatactatttactgttctactttttaaaactttttaaaatyaattttattgaggtatgatttacatacaataaaatgtacccatttaaagtgtatggaggccgggcgccatggctcatgctgtaatcctagcactttgggaggccaaggcaggcggctcacttgaggtcaggaatttcaccagagatggtggaaccccatctctactaaaaaaaaaaaaaaaaaactcgag

SEQ ID NO: 2780 - DNA, 1514 bp, Homo sapiens
  misc_feature (453)..(453): n equals a,t,g, or c
  misc_feature (1107)..(1107): n equals a,t,g, or c
ggaactgatgcctggctgtggattgaaatggcttcctggccaactcctcttggctgtttaaaatgtttgtgaccccacctagacttaccttcaatttatttacactacgctcctggttctacgtttgtgactgtttattgtctttactcctttcaccttctggaaggtaaatgatagctattattaatatattaaagaggactagatccaaaagtttgtagtatatgtgtggtggggggggctttccctcatagggaagaaaaagtattagctttttcccacctgtcactaggttcgtggctragtcacctttaacagactacagattaagaagagaaaatamcmcaawtttatttaataaaagtttcacatgmcatgaagttttcagaaatgaagacccaaagatmcagggaamcctgtgtatttcagtgcttggatttgatgaagaatagncagtggtggggaaatgtgattggtcaaagcaggtaggatctaatggtaataaactggaggggagcttamcaaggcctgtttgtgcagattcttaatgttcctgtgttttcagagataasgacatttcctttcctcagggaatagcgagggcacctctggaatgagggtcttatgacttactttaggggaaggtcagaaaattgttttatggcctgtttcaggggagaagggtgggaggaggtcagaaaccttcctgcttctgctactttctcaaataccaaggtaccatattttggggtagcatttactgaaccctatcaccctcaatgttttcttcctttcactcttcactagcaacactcaagcatttttcccaactcatcattatgtctgaggcaggactttctcctcagaaagtggttcctgatgacctggttgataatccatgctttacatactcatcttcagcagtcatccactctgacattatctcccgtcactcactctggataggatttccaggtgtccattatttttatagacttttagcccttggcttccattttcagtcacctgtggaactcttcctcgtggatgtttagtaagtacttctaattaaatatgtctaaaatggaactcatccagttttccctncatcctcccaccaataagaaagcctgttgctattctgatgcaccgcctcccccggccccccactcctccccacagacacacacttaaatttttaatccttggccaggcacagtggctcacacctgtaatcccagcactttgggaggccgaggtgggcggatcgcctgaggtcgggagttcgggaccagcttggccaacatggtgaagacccgtctttactaaaaatacagaattagctgggggtggtggcacatgcctgtagtcccagctgctcgggatgctgaggcgggagaatcacttgagcctgggaggcggagtttgcggtgagccgagatcgcaccactgtactccagcctgggtgacaagcgaaactccatctcaaaaaaaaaaaaaaaaaaaaactcgag

SEQ ID NO: 2781 - DNA, 1079 bp, Homo sapiens
ccacgcgtccgctttagcctcccgagtagctggtactataggcacgcaccactacgcctagctaatttttgtatttttttgtggagatggggtttcaccgtatctcctaggctggatagttaccaatattaactgtcaatatttgatagcaaaatctgtcttaaaaatgtctttttacagattggttcattcaaatcaggatctaaacagtttaaggggtttgctcatggaatttgtttttctctttcatctgtttcagtctaaagcagtctttccttctttttcttttccttgctgttgccttgtagaaatccagtcatccatccagtagaatgtccagcattctaaggacattctaaggcttttttttttttaatcctctttgtagcgagcttcttcctctatctcctgcattttctataaaatgaaagtttattatataggcttgattcagttcaggtccttttttgaggaagaatagaatacttcataggtagtggtttattcatcagactgttagaagatacaaaaggtttcgttgtccttcttttagttatactaagataaattgctggattcaagtaataagcctaatactgccattgtggaattctccatcagattttaatcatccattgataatcattgctggaatttattatttcatttaggattacaaaagggtaatatttatttatttgtttgtttgttttttattttttttgagacagtgtctcattctgtcacccaggctggagtgctgtggagcaatctgagatcactgtascctccacctcccgggtacaagcagttctcctgcctcagcttcccgagtagctgggactacaggcatgtgccacaacgcctggctgatttttgtagttttagtaagagaccgggtttcgccatgttggccaggctggtgttgaactcctgacgtcaggtgatctacctgccttggcctcccaaagtgctgggattacaggcatgagccaccatgcccggccaaaaggataatattttaaatctgtgattccttccccagttactagctgcaattctgtaaaaaaaaaaaaaaa

SEQ ID NO: 2782 - DNA, 2814 bp, Homo sapiens
  misc_feature (1565)..(1565): n equals a,t,g, or c
ggaaagggtggccgagcgcgggcggaggacggagaagggggcggcgagggccggaatctcgagcttgttttcacttgctttttaaakacagaaagctcatggtgcaaattgttatttccagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctkgacctaacctgagagccggtgttctgttaacctctgggaatggtcctcccaatcctaggccagttggctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggcccnaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggcaaaaaaaaaaaaaaaaaaaaaaaaaaaaaaaawaaaaaaaaaaaaaaaaaaaaa

SEQ ID NO: 2783 - DNA, 2200 bp, Homo sapiens
ggcacgaggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgttgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaacctttctaatatcttttgttagggttataccatgaataaaatgcttctttagcttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaagtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaagctaagtacttcctatataattcatcacttttctggctacagcaggacagaatatgaccatcttcgtttgaaggcaccaaatcgtcgcagtgtctttgccataagttgcagggttaaatgcgggaatctctcctcgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaaaaaaaaaaaaaaaaaaaaaaaaaaaaaaaaaaaaaaaaaaaaaaaaa

SEQ ID NO: 2784 - DNA, 966 bp, Homo sapiens
caagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaarcgcgcgcgcatgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcctctttccaacacgtgttcacaatctccaaagggactgtatttcttctctgtgcttaatgtgatttgaaatatgttgaatcaaagtgaaatatttattttttgaataaaggagataatagccttaaaaaaaaaaaaaaaaaaaaaaagggcgggccgc

SEQ ID NO: 2785 - DNA, 1512 bp, Homo sapiens
ggcacgagcttccttggagcctgagtgtgagaggaagctaatgtcagccgggctagacaccgtttaaagtctaatccatgaaaccctaagccgcaaatgacacttggggctttgcagacacccgcagactcagcagatactcctgcggtaacacactgtgctggaaaacgcctggagccatgacacattatgtatttttattattatttatggtaggaagaggagatgagggaaaatcgggctgaatctaagcagcctgacaattcagctagttaatatttagccagttaagaaaggtggttgtaatccctgcaaggcagtgagctctcctttgatttctctaatagcttaaaaaataatttcttacaagacaattagaaattctgcctatggatgcaaatttcatagaaaacaatgttaagccttgaaagtgggtaaaatgtgccttcgattgaagtcatttattctgttgatacacttctacaacatatatattttaaacctgctcagataaagtgaaatttagcaaaaggatatcccctcccacccccaaatctaacatgccattttaaaaacagcacaaaggaacaaggaaactaaatattattttgagccatcattacttagtgaaatacaaacatccaaatagaaacgattgttgttccaccagaagattagaagttaaattatttccacacaataggaatttcacttcgtgtcatcggggatgtagtaggagttgcattatttgtcaaaccaaatagaaatgcgtgggctgactgctgaaatacaaaagaattgaaccttatctgaaggcgttttctaagtggcccctcccatagaagccgggaagttgtccacccctagcagaagccacattaatatttacaaaatggttataaatccttgaagacatttttgcccattttgtataagaaacaggagtaaacaaggtgtttatacttgttatgtttcattaatgaaatattattactttacatcttggggaatgtttgttttctttagaaatgaactaatgatcactacaaaggaagaattcctgacagcatttcctagagaaaaagcttaggtacgcgtctccaaatgatggtttctttttctacaccttagctttttcatagctcaattcttcttacaacttctcttgtgttttttctttgattgtcagttttctttcaaagtttattttttgttacttaatgcagaaaagtgagctctggtctccccagtgtaaaagtcgattgtgtctagaaagaaggcagtaaaaacagcaaagcaggcgctgctttcaaaaagccctgcccaaatcatcccgcccagaaccttcttaggtttgcatcctcatttccccctcccctaatttcaatagctggaaagtaatcaagtatcccgaggaccaatttatgcactagactccaaataaataaaatatttttttcaaagtgtcaaaaaaaaaaaaaaaaaaaaaaaaaaaaaaaaaaaaaaaaaaaa

SEQ ID NO: 2786 - DNA, 946 bp, Homo sapiens
ggcacgagtgcagacgctggtctggttcctgctcaccctgctgctggcgctcttcatccctgacatcggcaaggtgatctcagtcattggaggcctggccgcctgcttcatcttcgtcttcccagggctgtgctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtcccctctcctgctccccagtcctggcagtgccgtggatggcggcaggaagtctcacatcaaggaggacccctcctcctctcccagttctcaactttctcatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttaaaaaaaaaaaaaaaaaaaaaaaaaaaaaaaaaaaaaaaaaaaaaaaaaaaaaaaaaaaaaaaaaaaaaaaaaaa

SEQ ID NO: 2787 - DNA, 1570 bp, Homo sapiens
  misc_feature (412)..(412): n equals a,t,g, or c
  misc_feature (502)..(502): n equals a,t,g, or c
gaattcggcacgagcagataaccaaaccagactggaagaggataacaagatcccaaagaggaaaaaaaattgttcttccaggatgtcaaacctatctttgagatattcatcatccaaagggtcctggggttctctttttccaaatattaggataatgcaaatattcctgctcatggtggacgcacactgtgtttacatcagtcaacccttcaaacatgagtcagagaaatctttctctaaatgaaggtgccatttctattgacagctcaacttcgtaaaggtatgactttgagttgttttgactagtagaaagaaacatttgcccytttttgctctgtttctgtatttaggctttcacttgtcctagccaagattatttagatccccatacggraggtcaaatatgttaaangctaaataattagattctcttgatttacacaaaaaacataactaactaaaatagaaacttttaattatctgtattgttgtataaaatgtnttatatattaggaatctaaaaatttgttttttgcttgtatcctctgtcataggaagaaactcatgtctctgtttactgtaaccattaataaaggctaataacagacagtacatgatgatacttttaactagggcaaacaaaagtaatattttaacaatgaggtttggtctttgctatctatacctcatgtctaattttccctacaatgtaaatgtcattcctcctctctacccatttgtaagggtctcagttttctgctcttgcatgacttattttaaagggtcacaataaggccaggtaattcatattttaaaaattccatttagaataattacatctaaaaattcacaagaaagacaatttcaatataaaataataaattactaatattggaatttcaagcatkagtcatggcaaaaaagagataatttgtagcagaatattttaatggcaactttcttattctatcacttattgtgttctatttgttatgaccaaagaaattactctatatccactacaattcataaaacaggcatgaggaagtctttttttcttggtgctcatgtctaagaagatgamcctcagaggtatgtcatttttcaatactatgttctgaacagacagcacacattatttttgaatggacaacaaaatctcaaaacatatatagagaggtatggtttgaggtgtgtccagtatgaggataatatgacccagcggatgtwaaattggattttattattaaaggaaaatggggtgtcttcaaaaagataaaacagcgggagttgggatgagtactgagaaaagagcacaaaaacaggcttgtagaggaggaagatctcaacagagctgactcttatctgtgctcacattcaaaactgacttttgaacaaaagctgcatcctttgccctatactatagtcccaactactctggaggccaaggcaggagaatcacttgaacctgggaggtggaggttgcagtgagccgagatcgtgccactgcactccagcccgcgcaacagagcaagactctatctcaaaaaaaaaaaaaaaaaaaactcga

SEQ ID NO: 2788 - DNA, 2418 bp, Homo sapiens
  misc_feature (138)..(138): n equals a,t,g, or c
  misc_feature (171)..(171): n equals a,t,g, or c
gctcgtgccgctgttgaccccactgagcagtgctaagtgttggtttagtggatgttcgtggaattgctgacccatccaagggcgtcctttggagccagtggagcctgccggcgcatctraggggcagaatgctgctancacttgaatctgggatctcgccttattctcaantagcaaggcatctcgacaagcatggtctargtctggtggccagcttgccartacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctttactttttttttccaagtggggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgascagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacrgaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaaaaaaaaaaaaaaaaaaaaaaaaaaaactcgag

SEQ ID NO: 2789 - DNA, 2220 bp, Homo sapiens
gaattcggcacgagagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacaactgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcagtcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaactcagtaataaactccctggcctctgccatctgcaaagttcagcagtacatgttgaccttattcgctgccatgttgtcctgtgggattcatcttcaaagactaatccaagaaaagggttttgtctccacaattatccgtttacttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaaggtactggaagttcaaatttctttttcttgtgtctcacctctaaaatgaattttatgtgttgtgaaaatgttattaaagatgagattccaaaagaaaaaaaaaaaaaaaaaaaaaaaaaaaaaaaaaaaaaaaaaaaaaaaaaaaaaaaa

SEQ ID NO: 2790 - DNA, 1721 bp, Homo sapiens
ggcacgagcaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgtgcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttcccaacccttctctacttggctgctgttttaaagtttgcccttccccaaatttggatttttattacagatctaaagctctttcgattttatactgattaaatcagtactgcagtatttgattaaaaaaaaaaaaaaaaaaaaaaaaaaaaaaaaaaaaaa

SEQ ID NO: 2791 - DNA, 2267 bp, Homo sapiens
gggtcgacccacgcgtccgcccacgcgtccggaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagayagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttacygtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttraaaaaaaaaaaaaaaaactcgagggggggcccgtacccaac

SEQ ID NO: 2792 - DNA, 2158 bp, Homo sapiens
gagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccaccaaggaacccaagtctctgaattggtcgagttttgttagacaacacctttggctgaagaatttcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttatagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttaccgtactccaaatgattgctttcttttctggtgatatctgtgcttctcataattactgaaagctgcaatattttagtaatacttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaaaaaaaaaaaaaaaaaaaaaa

SEQ ID NO: 2793 - DNA, 763 bp, Homo sapiens
gctgcaggaattcggcacgagcagaggccaagatgaaatctccaccgacagaccttgctggattttcccactcagtctgtgactattagattatacccctttgtccaattgcatttgtacacagttgttcatgcttcagtcatgcctattcaatgaaatttccatagaaggcccaagaggaaagagtttgaagagcttccagaaaacggaacatgtggaggttcctggaagatagcaaggccggagagaacattgaagctttgtgagccttccctcatacctttccctatgcatctcttcatctgcaccctttggaatatcttttgtaataaacccgtttcctggagttcagtaagctgctctaacaagtttatcaaacccaaggagggggttgtgggaataccaatttacaggcggttggttagaagcacaagttaaacaacctggggcttgtgattgacattggaagtgggggcagtcttgtgcgactgggcctgtggaatctgatgctatccccagagaaatagtcagaagacaaatggaggacagcaagctggtgttggctgaataattgattgcttgcttgctggtagggagagatccctacacatcttgtcatataagtcttatgttgattgctgtgatgtgagagtcagaggaaaaacagctggagttgtttttttttttcctaaccgtagtataaaatgtattcaaaatacaataaaaatattgctgaattaaaaaaaaaaaaaaaaaactcgta

SEQ ID NO: 2794 - DNA, 1134 bp, Homo sapiens
cggcacgagaaaagttccacaggaatagtttaagcatgatcctgagcacaaatttatttacagatttgttcatactctttttagtgctgcacagctaacagctgaatgtgcaacagtaactctggtttacttagaaaggcttttaacttatgctgaaatcgacatttgccccactaactagaaaaggattgttctgggagccactcttcttgcctccaaggtttgggatgatcaggctgtatggaatgtggactactgccagatcctcaaggacattacagttgaggacatgaatgaaatggaaaggcatttttcggagcttcttcagtttaatattaatgttcctgctagtgtttatgccaaacactaccttgaccatcgctccttagcagatgacaacctgaattttctatttgctcctcttagcaaagaaagagcacagaacctagaggctatttctagattatgtgaagacaaagacttgtgtggagcagctgtaagaaggtctttcagcgctgatcaacttcattggtattcagcactctaaagccatcctctcttaaagggagaaatgaggggttataatgtcacgggaccttcatctacaaagactggagaaataccacctttcctgctcaaaaaccagcaaaattagtgttttcatcaaaaggaaagatctcaaattcaagagacgcacggacaacaaggatcatactccatagaaaagaatggaaccttgtcaatgcaacaaaacactcttctgtcctttttaatgtaaacagagtcaccaaaaccactccaaagtgaaggctcccatcccacacacagatatttgcttacaatgtgggccagtaactgaactatgttaggttttttaaacaatagtttaaatttttagactttaaagacattaaccatataacttttatgtttcttccagtttttctccccctgctcattttgctgcatatgcctttagaatcaatgcagtattgcccttaaaacaagggactctaactaaagccacttaggagcagactgcagcattgttaggtattgaagggttcttcctccctactgttaccattaaagctgctagtcattggcaatcattttaaaaaaaaaaaaaaaaaa

SEQ ID NO: 2795 - DNA, 963 bp, Homo sapiens
ggcacgaggctgaatggccttttattaaaaatgtaagacattttaaataaaagaagttaaaaagtctgtggaagtattgagggtgagaatctctgctagctagatctctatattaagtgatgagataagctttattaaaaatgagaatcagttcatacttaacctaagcctgacagtgctgggcagagagtcctgctgtaccactaccaatggagccaggcaaggatgcctctctgctagacacagcacatatggacaaagccacaagctatggctcatcccaatagaatcttactagttccctggtaaggttagctataatgtcttctaactcacatcatttgcattaaaaaaagaaagaaacagatgatgactgatacacatgttggttggtagagctttcaggttcctctttccatgtagttgaggaaattcctcagcccattgtcacctcggatctcatgctgcaactccatccttagctcaacacccactggsccctgstttcaaactgttgctggtcttcaggtagagcaggttctgcagatcaaaggacatttttcactaaaaatctctgacatcagagacagagactacatatctataatgaacctttccgaaacctgtccattagaaagccacttctcagtacagaggtggaccttggagactttccaggattttcacatccatctgcgaagaggaaaagaactcctgaaactgggctgacttcataaccagtttaatttcacacatctcacctttctggagctgccttgtttttcccttcttgcatcactgcagagaaaattcatggacttcctaaaggtgagactctgacccattagtaagaaagtcttgctttatgttaagttggctttctctggagatctcctaactgctttataaacattctttcacacctccaaaaaaaaaaaaaaaaaaaaaaaaaaaaaactcgag

SEQ ID NO: 2796 - DNA, 1876 bp, Homo sapiens
ggcacgaggtggttggggcagggaggggaggaggaggagcttggcaagttatcttctccttccgtgaaacagagcactttaaagtgcttactttctttatcacttactttctcatattggccttccaggtatatgctcgtatgtcagaagtcttaggaataacagatgacaaccacgttctagagacgttcatgacaaaaatagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtmcaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagttta

SEQ ID NO: 2797 - DNA, 2202 bp, Homo sapiens
ggcacgagcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagccccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtatttttttaatttattttgtaatgtcttgttttgaagtattgctgctatccttgttatccttcccactgtttttatcactgattttattttgtgaaagttgtacactaatgttctatgtcaaaatcaaaaagtatttaaatggaaatactagttctatttaatgtggttatggaaccagctggaaacacaaaacaaacagtgattgtacagcaggctgggcccaggaggtcaggttcattttgttacatatgcaataaactcacgactttaaaaaaaaaaaaaaaaaaagg

SEQ ID NO: 2798 - DNA, 1316 bp, Homo sapiens
ctatgtgcgtttgctgtccatgttgtacatggcagagatgttgtcctcagttatgctcctgtctgtgctgcaagttcatcttcacctcagagcggaactgcacctgcttcccctgcccttacaaagatgagcggaactgccagttctgccactgcacctgttctgagagccccaactgccattggtgttgctgctcttgggccaatgatcccaactgtaagtgctgctgcacagccagcagcaatctcaactgctactactatgagagccgctgctgccgcaataccatcatcactttccacaagggccgcctcaggagcatccatacctcctccaagactgccctgcgcactgggagcagcgatacccaggtggatgaagtaaagtcaataccagccaacagtcacctggtgaaccacctcaattgccccatgtgcagccggctgcgcctgcactcattcatgctgccctgcaaccacagcctgtgcgagaagtgcctgcggcagctgcagaagcacgccgaggtcaccgagaacttcttcatcctcatctgcccagtgtgcgaccgctcgcactgcatgccctacagcaacaagatgcagctgcccgagaactacctgcacgggcgtctcaccaagcgctacatgcaggagcacggctacctcaagtggcgctttgaccgctcctccgggcccatcctctgccaggtctgccgcaacaggcgcatcgcttacaagcgctgcatcacctgccgcctcaacctgtgcaacgactgcctcaaggccttccactcggatgtggccatgcaagaccacgtctttgtggacaccagcgccgaggaacaggacgagaagatctgcatccaccacccatccagccgcatcatcgagtactgccgcaatgacaacaaattgctctgcaccttctgcaagttctctttccacaatggccacgacaccattagcctcatcgacgcctgctccgagagggccgcctcactcttcagcgccatcgccaagttcaaagcaggtggtaacaccagatggacatgggaagaaccgagctaagtggggcctgctgaagaatatccagtctgccctccagaagcacttctgagccccttcagagcaggaaacaacctcagactcatcacaaagtagacatatacacacacatatatgtatgtatatttttctcaccacattcttcaaggaggttgtagacaaatgtttccatgacctctcagctttccaacaggaatcttgtaagagctaataaaaggaaatacctgaaaaaaaaaaaaaaaaaaaaaaaaa

SEQ ID NO: 2799 - DNA, 1167 bp, Homo sapiens
ggcacgagtgtgtttgtatttaattagtaaagatgttcatctcaccccattatatcatgatgtacttgatgccaacatggcttataactcataatgttaaccttgatcatttagttaaggtagtgtttgccaggtttcttcactataaagttaatatttttccatttccatactattttctttgaaagtgagtcattgtaattccataccacaaccaaaaggacaggattaatctctatctcctagagaggagtgtctacatatattctttagaattcttttttttttttttttgagatggagtcttgctctgtcacccaggctggagtgcaatggcgtgatctcggctcactgcaacctccacctcccgggttcaagcgatcctccatgcctcagcctcctgagcagctaggattacaggcacctgccacagtgcccagctaatttttgtatttttagtagagacagggtttcatcatgttggccaggctggtttcgaactcctgacctcaggtgatccgcctgccttggcatctcaggttgctgggattacagacgtgaatcactgcgccaagcctagaattcttctataagataaatttctccctttatcacttaagtatttattcaataatacttatatcattatggactcatggatatttattttactctctgaattataatccaatactatcactgttttgttggtttttttgggtttttttgtttttgtttttgtttttttgctgaaattgttccagctttggccactggggaactctttccaattgcctctggtgtccttttgacctctctcctacttttataattttcttttttttttttttttttttttttagcactataagatgttccagactcgtcttgcgttttccctcctttaattggaaatggtatttagaaactaagatttgtgaactggtcatgcttgttgttactgtggtgtcactatgtgttaggctgttcttgtattgctataaagaaacacctggccaggtgccgtggctcatgcctgtaatcccagcactttgggaggccgaggcaggtggatcatgaggtcaagagatcgagatcatgctggccaacatggtgaaaccctgactctactaaaaatacaaaaaaaaaaaaaaaaaaaaaaaaaaa

SEQ ID NO: 2800 - DNA, 1436 bp, Homo sapiens
gaaaacctgggcacaaaattgggttgactgtgaatcattgtgatgcctgatcactctcctgagacacccaccatcattggtactggttgcctgctcttgacaccggaggccactttgtgtacttagcagttagaaaggtgatgtgtgaggcccggcagctgttggtgttacagctattgtgtgggaaacaaaagccattctgttctgttccccagcctgcctttgtatcacggatagaggagctgtttcataaatgagatgagttatgctttaaaccatacaaacagaaaactaacattggaacctaaaattactgtcaatgccaagatcattgtggttggtgcatccagtgttggaatttccttcctagagacattggtattttgaatcttttgaagagcctgtaatggcactagaaaaatgcttactggagtcatggatgacagtgactgaaagcagcccagctggtgtccccgcgaccctccgtgtgactagagagaaacactgattcataggaagcaccggtgggcactggaaagcccgggttccccttgtcttccacttccaccactcagaagagttttctcgaaaactgaccaaatcatccagcaaaagatgcagcctcagactttcagcctagacactgatcccctcatctggttgaatgtgtcgaggtaactaagaatagcttggaccaagcagggcatgtttctaaagctgcaattgtggcaatgaccacaactcctgttatcgggccgtgcagttccgcacaatatccggcacagctgtgggctctggcagcagccagcctagcgctggcggcttaattaggctttttatctttacatttgtctgaggacatctgaaaccttcagtgtggcctgtcactaattaggtgactaattaaatagtcagtgcttccttgctgatctcagagctcaaccgcaatggacaggtttgtgattgtgactccccgtcctgtcggtctctgcacgtgtgcgcctcgcaattgccctgttcattgcgctgtgcaaaaacggcatgggagcgaggcccagggcatgtgcagggccgtcctccgatgtgcccaagcagcaggcagcacggacatccacaggggggcatatgggagatggacatccacagggcatacgggacatcagttctggtgcagaggctggtctggtggccagagcagaggggacggtggaaggagctttacctgccaggctcagagtctcagtctccccaggcagcaagagttgacattctgccaccagagaataaggatccagaactcaccctggtgtcactaatcacaatggggtttcctattcgactccaatatttaaatgtaattaatgttaaataaaagcaccttcatttactgaaaaaaaaaaaaaaaaaaaaaaaaaaaaaaaaaaaaaaaactcgag

SEQ ID NO: 2801 - DNA, 2593 bp, Homo sapiens
  misc_feature (2583)..(2583): n equals a,t,g, or c
  misc_feature (2589)..(2589): n equals a,t,g, or c
  misc_feature (2592)..(2592): n equals a,t,g, or c
gggaaaacgtctatttacgttgaagttttaaaaatgcctaccccaggagggaaggaacaccgttattacctctctttggaatgttggaaaggaatggtccgtgtggccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccrtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttgggggaaagagaagagaatttcctgkggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacaaaaaaaaaaaaaaaarggggggccgcccnaggggnccna

SEQ ID NO: 2802 - DNA, 673 bp, Homo sapiens
  misc_feature (245)..(245): n equals a,t,g, or c
gcggcacgaggttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgnagtataatttgattttattaccttcttttttacaagctgttttctcagtatttttcttggatgggatgacgctaggctggaaagtttttttcatcactatgattttataaaacaakkttttctatgarcctttacttacttgactggattggactaaaagcactgatcagaggccacgacataaaaattcagtccctttgtccttccccgtgcctcccaaagttactttaaratccttasaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaarmaaaaaaaaaaaaaactcgagggggggcccgaaa

SEQ ID NO: 2803 - DNA, 1051 bp, Homo sapiens
ggcagaggtgagaggtgacaacgtgctggcagccctcgctcactctcagcgccttctctgcctcggcgtccggtctggccatgcttgaggagcccttcagccctccactgcgctgtgggggcccctctctgggctggccgaggccggagccggctccctctgcttgcagcccttcctctgacgtgcacaggatatgaaaatgtctgatagtgttgtggctgcagtgagacctgggagtggcagtttctttcactgcagttgtctgtccaaagcgaagtgaactagcaagtctcttacaaaagggcaagctctgaactgcgcacagtttttctcagtgggagaaatcttctgtgtccttggatgaagacttactcagtaaattactttatgatcactgatagctctgtggargtctccaatgtctcctctggamtgstataccagccacctgacagccatcctgcctccctcatccctctactacagtacgtactctaccagtactctgagccatctttcacagagttagtttgagcattccctagctcaaaactctcccattgcttcctgttgcactgagaattaaatctaaagacttcacagagtccctcaaggccctacagactcttggtccccatgctgcccctctgactcacctcctccctaccactcttgccttcctttctcatccccgtcactttggcccacttgatgttctttgaacacacacatctggctatctccccaagtctttgcaattgcttaaaccactcttcccagatacccagaagacttgctttctcattttcttaaattatctctgtattcaaatatcaccccctcaagaggtctatcctgactttctctctcaccttctccttttctttatgatatttagccataattcgccccccatacacatgcatttgtttattcatctgttggtttattgtctgtctcctcactaaaatgtaattactccaaaatgtaatttccacaatagcaataaatttatctttttattttaaaaaaaaaaaaaaaaaaactcgag

SEQ ID NO: 2804 - DNA, 743 bp, Homo sapiens
ggcacgagcctacgccctgcgtgcgctgtgctgactacctctccagcatgggaggcttccagatgagcagacacccgaatcccagcgggagcccgtcaaaaatggagatttctgccgtcactctgggactcttaattcggtccgtctggggtggggcccaggaatctgcatttctgataaggtcacccgctcccctcccccattattccagtgcaaagaggtcctaggcccagtgcccatcagctcctcaagacaggaattactatatctttttctgacaactgttaactttgtacaaggttagcaaataaatccaggaatgaatggaatcttaaaactcgtaaaacaacaatgaaaggtaattcacacaaaagatacaaaatccaaaattgtcaaaaaagatacagggaaaagtaaacatccatgttattcctatagtccagccttgcaattctctccacaagccattagtggtaatggtttcttggaaatattttcagatttwtttwgcccatatcagcatttttaacatcttttgtcataaatatgtcgtaaataacaatgttattgatacatatccttttaaaaacacaatggtagtatgctatactggcttgttttacttwtgaatatatgtagrgctgcctcgttccattgtaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2805 - DNA, 429 bp, Homo sapiens
ggcacgagcgccgcttggccctgctcggcctgcagcccgctccccgcttcgcccactcggggcccccgcgccagcggcccctgtctgccgcggaaatggctgttggacttgtggtgttttttacgaccttcttaacaccagctgcatatgtgctaggcaacctgaagcagttcagaaggaattagatggaagatgatgttgaacagctgttaacgtccaaaaaactttcagaaaaagctgtgtttttgttaacgagcaaaattgcctagttgagttgatgcaaccattgtggtattcactttcctcatgtttatgatgaatattttgcacttttttagtactgtgcattatatagatgtatagtcaaaaatgttctgcttaagtgttaaataaaacggaaacacttattcgtgaaaaaaaaaaaaaaaa

SEQ ID NO: 2806 - DNA, 1471 bp, Homo sapiens
ggcacgagttttttttcacattggaaattgggtgtaattgcatctcaagataggcataagcagagcttagactggggccccccagtggtatagtggtacaagtggttgactcacacacagcacctccactatgttttggccattagtcttcctcgttgactctggaacaacattgcctccacagcaaaggacttcatagtaaatttggtttataatgcagctgtattcaaaaatgggagagctagggaactaggatatgggaaaaaggcacagaggaaaacgtatggtttgaatgaataaggctcctacgactgtctcagcttctccacagcagccaggacgcccttttcactgctaaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaaaaaaaaaaaaaaaaaaaaaaa

SEQ ID NO: 2807 - DNA, 1154 bp, Homo sapiens
ggcacgagaatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttatacattaattataaaacatatatcatttgctgcatatttggaataccttgagaactgaatttttccaaggttgcagaatctcaaggaaaatgtttcttaaggaattaaataggaatgtctcttaacatttaaaatattttctttaattctttttgaaataatactatacattgtagaaaaagtgtcattgaccttttcatcagtccttgctgacaatgtattaaacagtatacagattaaaaaataaacaaaccgatgactataaaaaactgaactcaaaaaaaaaaaaaaaaaa

SEQ ID NO: 2808 - DNA, 395 bp, Homo sapiens
ggaattcggcacgagcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattaaaaaaaaaaaaaaaaaaaaaaaaaaaaaaaaaaaaaaaaaaaaaaaaaaaaaa

SEQ ID NO: 2809 - DNA, 975 bp, Homo sapiens
ggcagagtcaacggctcgcccagttatgcctccattttcctctgctgcatggccccaggagagattttaattagctttctaaccttggtccagattgcacatgcaaatggtagaggatgcaacacccccgcttgtggagctgccgcttgtgtctggcatgaaaattcacaagaagagaggaaatactgaggagaaaatggcagattgtgtttgctgaatttgattgacgargaagtcaccatgaaaatcacagtgaaccatttggaaagcaaactgccaaaaaaataatagttagtcatgctctcaggctggttgttttggctgttgtgggkttcttgcatttccagatgattgcaaagagctgtttctcaatttctgcaacaagtgccagctgaaattttggtaccagtttcattaaatatgtagaacaatttgagcctgagtgagttctgtggagcccatactacctgcgattcaagccagcaaccttggaatctccctgaacaatttctatggtgtccaatcacatttgcaatcactccccacactcagactgtgtatttttggctgctctccaagcccttgaggaaaacacttggagtcaatctcatccttttgatgcagtgctgagtaatgagagattttagaagatggaaaaaagaaaaatacattgcactctgaaacattctacataaaaatggaatgtgtggtcattagattaactcaggctttggacctcggggcataaaacccatttcctcttacaccagtctctgaagcttaaaggattcgttatttccagttgcaaatgccatcagaaaaggattgtttttctttctagtaccaccaagaatgtagtttaccattgtgaataaactgtcttaagctttccccgaataaaataaatacaaatgctcctcaacttaaaaaaaaaaaaaaaaaaaaaaaaaaaaaaaaaaaaaaaaaaaactcgag

SEQ ID NO: 2810 - DNA, 1158 bp, Homo sapiens
gatggaactaaaatttattatggtatgttccttaaagaaatggtcaaagggatgggaaggtcaggttgaaatcatatttcttcagactgataaagtgttttcattagagtccctcgttcatacgtgttgtctttgatgtttcttgctgttctactgctgattcttatgcttttcttaatattagtgtatcaccaagtatatatcagtcatggrgagaaaaaaataggtttgatgtaccaagggccttaaaatcacactgacctgatgaatcaaaattcacctcattgccaggacttggacctatatcgatggacacaattggtaacagcttccgaaagtcccacagctttgtaaccccacaggcatcacaggatgctatcatgtgacccctgggatcaaaaatggcatcatgatagaatgcmtgtgaccataaagtgactgctcamatwtaccctaggaagmcaaagcmgaaacagrgtcaaataaatttattacatttcatcattagacagtgctgagctaggrgaatcataggagatgttgtcagaagaaaagcggaggagcagatcatgtaggtcactggaaggacattagcttctatttgaataaaatgaaaatcctttcttgagactggccataggagtgactgatcagagtcacatgttgcaagaatcactctgttttaccatgtcgagattaaactataagagagcagagatgttcttgcatcccatatagacagggtcttgtctgcagagcttgtgagaagagtattggagaaaggaaaaaactcaatgctgttcacagaatctgtatgtccatacaaagtacatctgcatctttcactattaacatcccaaattttgctagttttatccagtgaggaggaagccacaaaattgccgcaggagtgccatgtgcaggaccacactgcgcggctgtgtccttcaaaggtcaaaatgcaatcgcctgtacatagatcccataatttaactgtagtgtcaccacttgaagtagccaatttgtcgccatagagcttccagcccagttgttccacttctgtgtaaattcagctgcaggatacagcctcctgatgtcccgggaaacactcaggtggcaggaggctgcacatgaccccacccacttttgcggcacgag

SEQ ID NO: 2811 - DNA, 754 bp, Homo sapiens
ggcacgagtcgggatcgggagagtccaccacgcctgcctgctcggctgagaatcgccatgccagctaaagggaaaaaaggaaaaggccagggcaagtctcatgggaagaaacagaagaaaccagaagtggacattctcagccccgcggccatgctgaacctctactacatcgcccacaacgtcgctgactgcctgcatctgcgaggcttccattggccgggtgctcccaaaggaaagaaagggagaagcaagtgacagcatttcacaacacatctctgttacagacaacaggacctggggaagagaagtcaggataacacaactgttgccagcaacatagactttactccagacgacttgagatgcaaattaagtgtgcttttctgtgatggtggaagatcaggaaatgcaccttacttcctctgttatgccagatatggttagccactttggttttttaggagctataggatgggaaaagcctgagtaattcctacacagtgtgctgaaattaatagaactttcagaaattattataattctgggtcaggattaaactttgctctcagaaggcagttctagttgcattaattgttttcttttgccaaagagcgtttgtcatttagagaagacacggcaagaaacactgggtttccttaggaacattcctctcttgggcaccatttccttttttttttttaatggaaaataataaatactttgtttctataaaaaaaaaaaaaaaaaaaaaaaa

SEQ ID NO: 2812 - DNA, 2908 bp, Homo sapiens
  misc_feature (1616)..(1616): n equals a,t,g, or c
ggcacgagggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcrttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgcgtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaawartatggattgactgtttctaaaataccaatctgtggctgtggttttycttttcttcagcatttccagcatccaagtaaacaatagtcccttatagtcctgctacttgatgggtaaatttggttgctgggtttttaagttgcactcacaataaatcgtgcaaagcattgtgcatgccttatttactccatttttaatcctgcatcccagatttatggcagcaacacatatctacaggatacttttatgttgtccaaatattgctgtcagtgcatatgtacttataaaatgtctccactcatgtatatttatagaaatgnatcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttcaaaaaaaaaaaaaaaaaaaaaaaaaaaaaaaaaaaaaaaaaaaaaaaaaaaaaaaaaaaactcgag

SEQ ID NO: 2813 - DNA, 688 bp, Homo sapiens
ggcagaggtcttacttacctacctagcatggtgcctggcaatgttctgcgtggtggtcctctcactggaagctacaggttacggcaggttcaccttcactgggggtccgctgatgaccacggctccgagcacatagtagatggagtgagctatgctgcagagctccatgttgttcactggaattcagacaaataccccagctttgtttaggcagctcatgaaccagatggactggctgtcttgggagtgtttttacagattggtgaacctaattcccaactgcaaaagattactgacactttggattccattaaagaaaagggtaaacaaactcgattcacaaattttgacctattgtctctgcttccaccatcctgggactactggacatatcctggttctcttacagttccacctcttcttgagagtgtcacatggattgttttaaagcaacctataaacatcagctctcaacagctggccaaatttcgcagtctcctgtgcacagcggagggtgaagcagcagcttttctggtgagcaatcaccgcccaccacagcctctaaagggccgcaaagtgagagcctctttccattaaaaattgtcaccaatgaactcccccaaacatggctgtggagagacaacaaaacaaaaccaaagcaccaaaagtcttctggccaaaaaaaaaa

SEQ ID NO: 2814 - DNA, 930 bp, Homo sapiens
  misc_feature (12)..(12): n equals a,t,g, or c
  misc_feature (27)..(27): n equals a,t,g, or c
  misc_feature (57)..(57): n equals a,t,g, or c
  misc_feature (63)..(63): n equals a,t,g, or c
  misc_feature (97)..(97): n equals a,t,g, or c
  misc_feature (925)..(925): n equals a,t,g, or c
gcttttgccccntgatttccgccaagnctcgaaatttaacccttcacttaagggganccaaangctgggagcttccaaccgcggtggcggcccgctnttagaacttagtggatccccccggggctgcaggaatttcggcacggagggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccaaaaaaaaaaaaaaaaaaacggcacgagggggggcccggacccaatcgncctaa

SEQ ID NO: 2815 - DNA, 1663 bp, Homo sapiens
tggcacgagctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacatgaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcaaaaaaaaaaaaaaaaaaaaaaaaaaaaaaaaaaaaaaaaaaaaaaa

SEQ ID NO: 2816 - DNA, 288 bp, Homo sapiens
ggaattcggcacgaggtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaaaaaaaaaaaaaaaaaaaaaaaaaaaaaa

SEQ ID NO: 2817 - DNA, 1719 bp, Homo sapiens
ttaatttcttttgtaggaagagcagtttgaactatatggaatccttcaaaattctaagaaagtgtttgccctgttctgtatatattctgccaaaagttgttcctaatagtctagatattgattctttatgtaagtagggtctttttaatcaaaagtgaagtgggaccaaattgttcagtggcttgttctcttctaaattgtttttagctgataagatttgggaaactttctgggcttccacaaataatatacaatacatccttgaatacttgatgcttaaaaagtgttgttactgcatgcaatcagggagctccagagctttttgcaggctccttgttcctgagaagcaatattgttttcatattatctcggttatacattttatggttgtgacattgctttctttttgtttttgctgttgttttctgctgctgctgatttagaaatgaaataagctaactcttaattttaacctgtttgctacctaaaatggtaatcatcttgatgttctttcaagcaggtcccagagatcttaaaatgatccggaatcactgagtccacagttctcttttctcttggttatgtatagatggagagtggtcttggcgttatattagtgtatgattcgtatttgtttcataattaacttcgaagtgaaaaattgatgcgagagcaaaggtttatttggcttccataactatttactaattttatgcttgccagattttaagattaaactgtttgccatctcttgtaatttttcttcccataaaacctttggccatctacagtcacttttcctcaaatcttatgctgtaattcaaactgtatattctttttgctgattgcttctgtacctcttctgcttccagtgttcttttgcaagagtgtccacacagtgggaagaaaacctgaacttgactcatgaagtgctgggcattcaaaacagtgaatccttgcaaaggatcttgggagtagacccctgtgaattggctctttcaatttgtccacttaaagggcgtaatagattatgcagctgtttgggcttcagcagggtattgctccatattcatgcctagttgcaattatgtgaattttcagtttgttacaaagacttccctttgtattcaaaacaattttgttggctttgtgttctaatatttgagttttctctgaggaaaaatagttgcaagattttgaactttgaaaacttcaaattaaaatgtttaaaggttttgtcactttttattttctgatgcaaaccatacattgaaagcatattttaagaagaagtcactctaataagctttaatttcgagtttatgaatcacaggatttttggtagaggtaaaaactatacttacaccgtaaattagacattaaatgccatttaatcagtcagataatgattaatgttagagtaatgtttgatgggccaagctgctaaaacataagcagttctaatttaaatatataaacttatcacgtaaaaatagcaaacttagtaatgtataaagtgacagtaggtcttttttgcttaaaaatcagagttcctgtgtagtgtctctttatgatctctgtagtaaaaatattatttaacgtagcttagtgagaagtttaagaggagtataccttttactttagggtgcccatgccactttgaagttatggagtgcaaagtagtttccacacattaaaaaaaaaaaaaaaacggcacga

SEQ ID NO: 2818 - DNA, 3299 bp, Homo sapiens
gcgttggagctcccggaaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacrggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttrctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccrtacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacaaaaaaaaaaaaaaaaaaaaaaaaaaaaaaaaaaaaaaaaaaaaaaaaagg

SEQ ID NO: 2819 - DNA, 1633 bp, Homo sapiens
  misc_feature (22)..(22): n equals a,t,g, or c
  misc_feature (38)..(38): n equals a,t,g, or c
tgggctttatcgaattatggcnctttgacccctctaantcagactcacgcyaatgtcttaatggagagtgaaataactaagaggagttacagcaagcttgtccggcctacagcccacatgcaacccaggaaggctttgaatgtaacccaacacaaatttgtaaacattcttaaaacattatgagatttttttgtgtgatttttgttttttagctcatcagctattgttagtgttagtatattttatgtgtggcccaagmcaattcttctaccagtgtggcccagggaagccaaaagattggmcacctctgagttatagtgttgagccttaagatcaatcttatgatttcacctttccaatttttttattccaatggcttgtggataatataagcattcatttgcaaaaacaatactgagtactagtatatgattagtatcagccctcttccaaaagacaaagagagataagtagctagccatgcaggtctgtaaaaagttgacagtgatggtatcaaatatggagtcaaatctgggttttcattttaggtgttacttttgagaaatgcagattactgtaggcattgaacattatagcctagtcttgctgcttgaatttcctaacttactatctggcccaactgcttcctctcctaacacccctctccacaaccttctaggttttcaaggacattagtaacaatgacttttgtcattaataaaagctgtaaaaagggacatctatacaattgagaaacaacagagaggaaaggaagctacttttaggaacctatatgtggcctactcattactggcccagtttcttcaaggaaagcttactccattctaagggtgaagattttagtcaagagcttgattagtgtttgacactttgatagaaaaagcagagtggtgactgcttatttattcaaagttttcktttcccaacaacgttcacatctgtgggtcataagcatgaagatgcccagcataggttattatcgaaagaagaggcccccttcmcaaacctgcccagttattacatatgctacctgttcatttaccatagaaagatgtaccmayttttccagaattatttkgaaaaaataaytgctaattttggacacttaataaaatggaaagtaccactgagataagtttaataccagaataaatgcatattatactygaatgcttacaatatgagaatatagcaacagcctgttttgccttaccaggacatcaagaatctgatcagtttcacaccttttactggcakatagtaatagaggatggaaagataaggtctcaaatactgtgatctggccaggcacagtggctcatatctgaatcccagcactttgggaggctggggcggacagatcacctgaagctggcagatcgcctgaggccaagagttcaagaccagcctagccaacatgatgaaaccctgtctctactaataatacaaaaaattagccgagcatggtggcacacgcctgtaatcccagctactcaagaggctaaggcaggagaatcgcttgaacccgggaggcagaggttgcagtgagccgagatcgcgtcattgcactgcagcctgggcgacaagagcaaaactccatctcaaaaaaaaa

SEQ ID NO: 2820 - DNA, 890 bp, Homo sapiens
ggcacaggaaatgaggcatctgttgttggcttccctgtggagtttgtgtccctccctgagctcccgcctctgtggggccagccccagtgtggacttgtggccccctgtgctgctgggcctcaggtttgggtctgcggagtacatgggtgtgagtgctctgaccactggactcttaaaacatgcagccctctttgactgtgacactggacatgtgcaaagcttggggactgatcaaaaagtataaagaggccattgaaaaagaccttgactcctgcacccagaggtagcaccaagaacatggcatgcatttcatctccacgtctcccttctctcctttcctcccctgttcattcattcagccaatctatcagccaaccagtaagcactcacggacacccacgtgcgcaggtgccatggaggcagccgagtgtggggactgctgtggcaaagctggcagccttgtgtgcttcctgcacttgtgacattttattgcagccagtgcctgtgccattaagcattccttgaaaataaaatcttttttggctgtacgatgtttcttcgtgtagacataccaaaagtaaactcttggccggctgcggtggctcatgcctgtaaccctagcactttgggaggctgagacgggtggattgcctgagctcaggagttcggaccagcctgggcaacacggtgaaaccccgtctctactaaaatacaaaaaattagttgggcgtggtggtgtgtgcctgtagtcccacctactcaggaggctgaggcaggagaatcgcttgaacccgggagacaaaggttgctgtgagcctagatcacaccattgcactccagcctgggcgacagcgaactccgtctccaaaaaaaaaaaaaaaaaactcgag

SEQ ID NO: 2821 - DNA, 1074 bp, Homo sapiens
gatttaagaatcatcattctaggttatrtacctgggagtggaattactgtgatatatagggtatgtatatctcaatttctaatgtaacagggtttcagagatcctcttcacattcttgccaaaactttggagtattattttgccagcctaatcagcttgaaaagttatctcattgttttaatttgcatgtttctgatttccagtgaggttatgcatgtattcttaacatttattggcctttcaggaactttctgtgagttacctgttacattcctttgctgaatatttaatcgtttgttttttcatatttatttatagggattattttaaaattctgcatatgaatcctttctgttgtttagcaaatatctttgcccagtggatgacttaccttttaactttgttcctgatgtcttttgttgagcaaaagtctttcattttaatgttatcagattatcggtattttattcaatggtttgtgctttttgaatcattttaaggagatccttccctacaaatcaataagaaaaatacaaacaacacaataaaaataaaagtgtttataaaaacagacataacrggcagttcacrgaggcaaaaacaccagtggcctatagacttaagaaatctcattagtawtcaataaatgcmaaataaatctatactatgatatatacatttagtacttagaatgctggcatatatttaaaggcctgacaatgccaastattggtgaacatacgaaacaataagaactctatgtaacctcagcactttgggaggccgaggccagcagatcacctgaggtcaggagttcgagaccagcctggccaatgtggcaaaaccccgtctctactaaaaatactaaaaattagccgagtttgatggcacacacttgtaatcgcagctgctcaggaggctgaggcatgagaatctcttgaacccaggaggtggaggttgcagtgacccaagatcatgccactgcactccaacactccagcctgggtgacagagcgagactctgtctcaaaaaaaaaaaaaaaaaaaaaaaaagaaaaaaaaaaaaaaaaaaaa

SEQ ID NO: 2822 - DNA, 631 bp, Homo sapiens
ggcacgagagaatgagcagagcagcatctaacaaaggacggggtcccctctcagcttctctgtcttcacaagtgaatgtcacacattttaaactagaactctttctacttatttagcacctaacagatgctacgagagttctggttactttttcttttctgtttgggtcgggagcacatgtctaagtgtgacaaatgtgagcagattatttggagaggtgaggaaatacaggaaagaggggggccagtcttttctctcttttggaaaaataatcatttttcgtagaaaccagatactttcataatactctttttttttaaagaaatgttttaacatgaaaaaaatttcaaagatacatacaagtagagataatagtgtaataagtccccatgtactttttgtccagctttaacaattagcagcatgtggcctgattttgttttacacatatcctctctcctgtattattttggagcaaatttgatacgttatttctttctttctttctttttttttttccttagacagggtcttgctctgtcacccaggctggagtgcagtgagccaagatcgcaccacttcagcttgggcaacaaagcaagattctatctcaaaaaaaaaaaaaaaaaaa

SEQ ID NO: 2823 - DNA, 1104 bp, Homo sapiens
tgcaggaattcggcacgagcttcacatttttctattccactcccagcccaaaaatactaaaaacagaaagaacaaagtccatacaaagagtatttcatgaaaaatttaacccacttttttctttcgctttcttccctctcctcttttctttttcttgtctcctcttctttctcacgcagggcagggccgggccagggttagcgggccagggtaaggtcggagctgctccaacttctggtgtgtacttgttagtctttatgatattcttgtagattcaatcatgaaacatgagtttgatgctggtgtgattgtaggtggtcttgcagtcaggtgaacagttgctcccaaagagaactgacggctcagcctcagcctggaggggatgtagacctctcgtgacataactcagtgctgggagggaagtcaacagagtgaatcaaggacagaaccaacactcaaaatgatggcaagagttgcagccaaagccagccagatgacacaccaacaaaatacagtaaagcccataaaggtcagtccttggcttcagagaaaaccatagtgggcagtgatgcatttggaaaatatctggaaaccttgcctgctggcagacactgtgggttatctatgggatccagctgctaactccatcaatgtgaccttacacttcattaatggaagtgtctacctaactggatgtaacagcctcctcactaacttatatttacagtgctgcccctgagtcagcagtaaaagttcaaattatattcagaatcttctgcttaataaattagaaaagtgctggccaggcgcggtggctcatgcctgtaatcccagcactttgggaggccgaggctggtggatcacttgaggtcgggggttcgagaccagcctggccgacatggtgaaaccccgtctctgctagggatacaagggttggctgggcgtggtggcgggcacctgtggtcccagctactcgggaggctgaggcaggagaattgctcaaacccaggaggtggaggttgcagtgagtcgagatcgcgccactgcactccagcctgttgatacagcgagactccatctcaaaaaaaaaaaaaaaaaactcga

SEQ ID NO: 2824 - DNA, 1803 bp, Homo sapiens
gccgattcattaatgcagcttggcacgacaggtttgccgactggaaagcggacagtgagcgcaacgcaattaatgtgagttagctcactcattaggcaccgcaggctttacactttatgcttccggctcgtatgttgtgtggaattgtgagcggatacaatttcacacaggaaacagctatgaccatgattacgccaagctcgaaattaaccctcactaaagggaacaaaagctggagctccaccgcggtggcggccgctctagaactagtggatcccccgggctgcaggtgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccgggcgcggtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaaaa

SEQ ID NO: 2825 - DNA, 1610 bp, Homo sapiens
gatttatcaaggtaatgccactttgatgtgtcttggttaggaatctttgttcacttgagggaatacatggtatatgataggaacagtaagcacagaatagagatgggaaagggagaaccctgtcataacagttaacatttcatatttgccaaacatgaatggcttatgcatattaacacatttaattctctcaaccattttatgacgtctgaggccactgaagcagctagaggttaaaccacttccctaaagtcattagtaagtggcagagccaggattaaaaatttaagtccttaactactttgccatcctgccacactctgcacatgcagacaagagtaagagccttaatcttgggaaaagatatttcacaagatctttgacaatttccatatccacagacaccatccagcttattagtgaccaccactcctatttgttactttctcctttaaggctgcccctacctgaactctggatcccagtaccatcactttctcaaggacctcccttctccagtgttgccctctcttgactcccctaccagcatctaaacatgctcagatctattgcatcttaagtcctctcctaactccacattcctttctacctactgccctagcttttccacttcacaactagaataccctcattgtatccaccttgggcctcctatttactcagtacatctggttcttaccaagatcactgataaccttcttgatactgtttaatagatccttttcaaccctcatcttatttgctcaatctttggcatttggcactgttgaccatcttgtctccttgaagcttccataatagcatatttaaaatttttctgtcttttcttctatcctcagcttcctttgggagctctccctccttcttctgtatgtccgttaaatgttgctgctcttcagtcttatgtcgcaggcccttaaatcttctcactgaaccaccttcctgtggcctcagttaccatccattgagctctgtgccgttggccgctagttcaacagtcaaaatgaaccaattatcttaaccccatacttcctcttcctataaaatctgtcctaggaaatttcacctctttgccaggccagaaatcagggcataatattaataaaatagttagcacatattgkgtactttcttcaatgccaggcactcttctaaccactttatatgtattagctcatcagactcagcctgataatatgagatgagtcctgtcattatccacatattagataacaaatctgagacatagaaaagtaatctgccttaggkcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtggtccgagtgctttgggaggccaaggcaggaggactgcttgagcccaggagtttgagaccagcctggacaacaaagtgagattcatctctacaaaaaaaaaaaaaaaacggcacgag

SEQ ID NO: 2826 - DNA, 1228 bp, Homo sapiens
  misc_feature (636)..(636): n equals a,t,g, or c
ggcacaggagatttttactttaaaaagcttctctcttaatctgggttttatattaaggggctcctcttattttacttctttgttcattgcactataaatatgaatataatgagagatctagtcttaaaaattgtatttttttacaacttcttaggcataacttgtttcacagttgctggaacaaacctcatcaacccagtttttgaacagtagaatattctctttgagaaaaagataggtaattagcattttgttctttctcatgtcattttccttggaaactatactgccttccttctccagttttcccaaatcagagaacaaaagaaggagggttgctgaaatgaaccttgttctttctggctgtcttcttacccattcctcagtgctgaactttttggggtgagagtgggggaatagggttggcagttgtctgccacggccccttacttgtttctggggaagacattcgaggtactcaccaagagatagagtgaagatggaattctttttagaagggaatacagttgacccaggaacagtgcgggggtgtggttagaagcactgaccttcttccctctgcagtcgaaaatcctcacgtgactttttttttttaaggctctgtcgcccaggccngagtgcagtggtgaaatcatagcttgctgcagcctctattgcccgggccaaagcaatcttcccacctcagcctcctctagctgggacaacaggtgttcacccttcctggctaagttttttgatttttagtagagatggagaatttcccaggatggtctcaaacttctaagcttaagcaatcctcctgcctcagcctcccaaggtgctgggattacaggcatgagccactatgcccggccactgtataactttgattctccaaaaatttaactactaatagtctactgttgaccagaagccttaccaataaaataagttgattaacacatttttaaaatatgtattattactgtgttcttacaatcaagtaagctagagaaaggaaaatgttatgatgaaaatcataaaaaaaaaaaaaagcccggcatggtggtgtgtgcctgtagtcttctgttactcaggaggctgaggtgagaggattgcttgagtccagaaattcaggctgtagtgagctatgatcgtgccgctgtactgcacccctggtgacagagcaagaccttgtctcttgaaaaaaaaaaaaaaaaaactcgag

SEQ ID NO: 2827 - DNA, 787 bp, Homo sapiens
  misc_feature (293)..(293): n equals a,t,g, or c
gaattcggcacgagctgaaacacattttttccctaaagcctcaagctccttcatacctctgtccccattcactcctctccccagaaccttacccacgttgaagggaaatggggaaggagagaggaragtttaccatattctgtgactattttataccaaaattatgccatgctttctaagcaaaattatgatatcctttataagatatcagttgtttcttcactwaataaaaataattttacactggctcattctaatattttgctggtccagccacttccctggtagtcatngaccccactctgscccagccaaggtyaaagtaggcaacctctggcyttggaaacagagccaggtcacttggcccacattkgagatggaacccatggccttgcctatgcatctctgatctcccagaaaacttttcttctagagatccaggactgagtgattcaggcaaccattacatgatgagaaatgtctctaaatccatctcatccccaagtatgttttcctaggctccaacatggcaataccctgcagtcctacagcaatcaagttagctttcatttcacgtgaaatagatgtgcgagtatctttttacataacggggaatacctccttatcattaaaaatattccactaccggctgggcccggtggctcacgccagtaatcccagcactttgggaggccgaggcgggcggatcacgatgtcaggagatcgataccacggtgaaaccctgtctctactaaaactaccaaaaaaaaaaaaaaaaaactcgtag

SEQ ID NO: 2828 - DNA, 1131 bp, Homo sapiens
gcaggatcacagctcacggcagcctcaacctccctggctcaagcgatccctcccctcagcctcctgagtagctgagactacaggtgagtgccaccacactcagctaatttttaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaaaaaaaaaaaaaaaaaaaaaaaaaaaaaaaaaaaaaaaaaaaaaaaaaaaaaaaaaaaaaaggtgc

SEQ ID NO: 2829 - DNA, 1133 bp, Homo sapiens
ggcacgagtgagtttcgaggctttgtatttgttctgtaaacaggcatataagacatgatggagttagtcctaatggcctctgaggtaagtggacaatctgctcaaatcctagcctccttcctggcactggtctctttataaatagggaatttgtagtggtgtagcagtagaatttgagaggcatatgagttggggctgtgctgctagaaacacagagttctgtctgccctttagtcagttttaaagagataatgttttgagacaaagggaggggcagttgtaataagctttatcatgaatctctttgggacctttcaagtcctatctcaccttggctggtgagagccccttggagccggctctactctttggtgtattctgacatatcccattattcttcaagcatttccttaaatttggtacggtaaacattccaggtttatcttgtgttttctccaccccagccatggcattagcatgtttcttaagagccgtgtcttctttaagtggaaaatggtatttaaaaatcaagctctgggtgctaagtgtagtacttcttgcttccggagagtcagtagttctactgggttctttcagctgatagaaatcgatctgtatgtgttatacacacatgcatccatagacttatctatatttagagctgtatatatgttgaagaccgtgaaatcaaactgatacttctaattctatccaaacaccaaagaatttactctagccttcttcctttccatattatgtatataactttcatcatcaatgagaaaccttactgccataatctttaagatatttacttaaatctcccctgtagggctgggtgtggtggctcatgcctgtaatcccagcactttgggaggccgaggtggttggatcacctgaggtcaggagttcaaaaccagcctggccaacatggtgaaaccctgtctctactaaaaatacaaaaattagctgggcatggtggaatgcatctgtaatcctagctacttaggaggctgaggcaggagaatcgcttgaacctggatggcggaggttgcagtgagccgagatcatgccactgcactccagcctggggacagagcaagactgtgtctcaaaaaaaaaaaaaaaaaaaa

SEQ ID NO: 2830 - DNA, 962 bp, Homo sapiens
  misc_feature (9)..(9): n equals a,t,g, or c
  misc_feature (13)..(13): n equals a,t,g, or c
  misc_feature (28)..(28): n equals a,t,g, or c
  misc_feature (41)..(41): n equals a,t,g, or c
cgggccatnaatnttaaaccccccctanagggcaattgggnccgggccccccccgarttttttttttttttttttgattgaacagaatttattggctgtctttgagtgtctttggtatggctttggcagggctgtctgggttcctccgctttgcttgtttttgggctgctgctgcagcctttaaggctcttcttcgcttcttcagcttttgagtctcctggaaaacccgaatgcacagagccttcttggtcacgaatcggcggtgggctcttcggtaatacagaggggggaaggtgtactcaattcccagcccccagcatatcttctcaaagacatcatagttggtgttacggaggtttttgagcatctttttcctctggtcaatgctcattagcagatagcgtttgtgggctttgtcctttcgatgtttctccaagtgttcttcataactgcggatcttgacagacaaggcaataattcgagcctccagggatctggtgtcctctgggtttgcaacaatcttcttcataaactgttcttgcttgatttttagcatctccttcttgttggccatttccaaagacaagagtcttttcacgacatcatcaaccttctcaattccagggacattctggtagtctttgagcagcgtagaaggaggtgggtcatcatccagcctagactgggctggtttccggacgacatatccgcgcgcggcctggaggaggagacttcgaggctgcaggccccactggttgaaaggaaacttggcgctcccaccgcccggcagcccgggtactaggacctgggtaactgcccgggtccgaatcaaactcagcgtcctccacgcgaccctcagcatggtgacctctaacccccgcggggccgcgccgcggccgccgttcgctttgcggcacggaccgggttacatgggcgccgccatgctggcccaggmtcgtgcc

SEQ ID NO: 2831 - DNA, 950 bp, Homo sapiens
gggctgcctgagcaggaaagcaggtaaaggaccaggggagaaacacctggggatgatgagaaaatcattttatgatacataagtgtgccagaaccaataaaatcggccctagtcacatttaagttactacgagtctgcttgaatataaacacagattttagcatagagttggaaggaatttttactttctagttaagagcatcctgctccagcagagtgaaatccatacggttatgcctttgataatattgtgtaaagcgattcattctgatgtcactcattttgtttcttttaataaacataaggtgggacttatctttggtactttctcagaggtagaaaggatgttttctttttttttttaattccacttcagaatgacaggccttgtattagttaatgtatatattttcactcttaaaatacatagtaagtacaaataaatacaattttctttgacctgaagagggagattgagttatatttcaagtcccctgtaaataaagatgccttggaaattatcatagtattttaaatagttaggacctaatgcttaatgaatgacaacatttacaagttgcaatatttcttcaggatgctaaaatcagtgctaaagtgaatcatttatttaagtaaaatgcattgagtatctccaggtttcctgttacgtgggaagatgttgtatttaaatgcattcctatcattttagcctctgaaagcacccatgaggacagaaacgtggaacacatggctgaagtgcacatagatattaggaagctcctacagtttcttgctggacaacaagtaaatcccacaaaggccttatgcagtgagtgtgcttctctgttttgtttttcatattctttcatattctaaatactgcagtcaactctagtctaacagattgcatatagtctcataaatccaaaaaaaaaaaaaaaaaactcgag

SEQ ID NO: 2832 - DNA, 1325 bp, Homo sapiens
gagacaaaatgaaatgcaaacatgctttgaaagagcacagtcttgtcctgtccctctgcatcccctctcctcatttctaatgaaaaaaatagtcttccctttccctggttccttcaacagtctcttccttaggttatttttttcctctctcctttcctactccatccagacttccccctgcctaatcttaaagagatgaattggaagaatatgcagtcgtgtcagaaggatgccattgtcagttcacacaggcagacactaataggataaagtattatctgacttcctttaagtccagaaattaagtcttcttgcaatggcaatagattataacttataaccactgtggctggcaggctgcagaaacaggctgttagtatctgaggcctcagctccatttctgggcctattgtgagggatgcactcagcattcctccaaacacagctgcatgatccagggaactggcacttggctcctggatggaactgcctctgtggagagctgcctataactcattcagttcacctgccgtgggagaagctgtctgaatggtcttaatgaacctggatgagtgggcaggtaaagggaggaagccagggtcttgaagactgggaagaagtagcccgaggcaaggaaaccaaactttgcacagggaacacttagtgtgtgaaagctcttctcagtcatccttgctgactcattgagcaggtagtaacttatctagtgactaaatcagcaccagcttagagacacagggaaatgagggttgagaccttaaaggaactgtaaaagagactacaaattaaggagttgccctggagaggaaatatcatgagaaatgttaggaagaaagagccatcattcttcaaaatggagggcctcatgcaggatttcctaggtcctgttatggcagatgagtgtactcaaatggggaatatgggacaggaaacctgatacaataattaattgaagggtatttttttattagtggggctataagaaggtaggtgggggctgggtacagtggctgacgcctgtaatcccagcactttgtgagcccaaggtgggcggcggattgcctgaggtcgggagtttcagaccagcctggccagcatggtgaaaccccgtgtctactaaaaatacaaaaattagccaggcgtggtggtgcgcacctgtaatcccagcaactcgggaagtgacgccaggagaatcgcttgaacccgggaggcggaggttgcagtgagccgagatcacaccactgcactccagcctgggcaacagagcaagactctctctcaaaaaaaaaaaaaaaaaaaaaaaaaaa

SEQ ID NO: 2833 - DNA, 2301 bp, Homo sapiens
gatttatgtaaaatgcgaaggcagccgctagccctacgctctctcctgtgtaccctgcccctggtcccaggtgtggccatctatctggtagggcccaggcctctgtcctcccggaaggcttcagtcctgagttctgccctttgctgacttctcaccttatcctctttccaagtctctcttctcttctctcctaaatttccttctcttttctcctccaaactcctcgccctgtgtttgctccaaaatacataaaacaaaaggtatgtggaaaaaagaatcagtagacttaaaggtagaaaattagagatttctctattgccgcaagtcacaagagttgtgagtcctgttaggatggagtgtgtcattttcatcacatcacattgataaatatgtctaggggctgataagccagtagggcatctaatttatgtaattttgatactatcttatatcttgtctggttgttacattcagtttcagtgaaaaaaaattgactttttttctttttctgtctttgaggggaggttgacaggaagggtccttgctaaaaggggagtcctggtactgaggtcagttgtgggtgtttatttgggggcagatgctgtcgctggggggttgtgatgcttccacctatgaaccgaccctggtctcctggtgactggagtgtgagtgattatgtcttcgtttctaggatcactataagaatagtagaattgtcctatccagagaattctgcagatgttcatgttccagttaatagaggtttgctttgaactggtgccttcgggagaagctttccagaaggagggagttttgtgcagtcttttgcctcgcaggcattactagataattgtggtgaagggagactgtatctgagccaatgttgctgcctgtcatggctaataaatgacaataaggaaaccatctttcactgaaccgttggtagaaggactacatttaaaaggcagaatttgtgagtgaaatgataggaactccatttccctgacacattttctgctttcttcccttttactcttttagcagtctgtccttaaagacttctgaagcctgacaagacccagcagtgaaagtgatctaatatattagccatcttttcctaaattaaaaatgaagcaaaataagagaacaagcatacaagctgagctcatgaatacaaatgtaggcttgcaagcccggtgagctgaagttcctgtggccctggtgtaatttttgatcttccaatgtctgtatctacctgaggattaaaaatatttaggttgttgcaaaagggcctgaggaatgcagggagggagttttctcattggcgaggctgataagaagttttaatatttatagttcacttttgttgttgttgttaaagtaaagccactctaaaaatggtagtttctacaaatcattagccaggaagcctgtctaaagctccagggaaggaccagaactcaaggtgggggtgctttgcaagctctcttgtcagggaaccgtgatgactagagttatggattactggctgtagaggtgccggcaaaataaccctgggcccaggagtcacatttagagcagggtgccccagaattgttctggagatacctttagctagctcgacttttatttcggaactgttggaagaatctaaagccatttcatcgtgagggtatatgaatctcaaatagttactgagtacctaccaggtattgggttctctgatggctcttgggtgagagttagaacagagtggatagctagatattagacaagttccttagatgaagcccaaacttgccacccgcatcctgagccgtgcaggtgccacctgtactttattttctgtgtgattgggttgtctattattttgtgtctgtatccattggagtaagaccctggggagagggcagggaccagacacgaagtccgcaggagctgggttcttaccctgattccaaggccgaagactttaaaaaattctacaagtcctggccgggtgtggtggctcacacttgtaatcccagcactttgggaggccgaggcaggtggatcacctgaggttgggagttcgtgacccgcctgaccaacatggagaaaccctgcctctactaaaaacacaaaattagccaggtgtggtgtcgtgtgcctgtaatcccagctactcaggagactgaggcaggagaattgcttgaacccgggaggtggaggttgcggtgagccaagatcgcgccattgcactctagcctgagcaacaagagcaaaactctgtctcaaaaaaaaaaaaaaaaaaaaaaaaaa

SEQ ID NO: 2834 - DNA, 2057 bp, Homo sapiens
ggcacgagcagggaagtacagtcctttctatgtgtctgcaaggaggactcacatctttggtgagcagcactgatgcctgctgcaacctggcatcccctttcctgtctcctttctttcctggtctgtgcagtagtagggtgtattagtccatttttgcactgcaataaaggcatacctgagattgggtaatttataaagaaaagaggtttaattggcttatggttctgcaggctgtacaggtttctgcttctggagaggcctcaggaaacttacaatcatggcagaaggtgaaggggaaacaggcacatctccacatggctggcaagaaaagggaagagcaaagggagaggtgctacacacttttaaacaaccagatctcatgagaactctatcatgagaacagtaagggggaagtctgcccccatgattcagtcgccttccaccaggcccctcctccaacactggggatttgggtggggacacagagccaaaccatatcataggggataggatccttcttatctggtttctttgctaccgtaattaatccatccttataggttcaattctaaaccctgaagacattagtatttcccattgcccttgggatacaaactatttcccttggaccataaggctctctccttatcagacaccaccctcccatgtatgccagcctctctcatactccaggaggtaaaaagctctcacttctgcctggaataatcatgacccctggccacccctctcagttgccaggccactctctctggcctttgaaactgtactcgcatgtcctggcctatccacccaaactaaagcatgcactgcctgttcctttcctttgaccacttatcacaatttatttatttatttatttttgtacatttgcttaatgtctttttccctccctggactgttggttcaccgtggttttcgcagggcctggtgcatagcaggggctcagtcatattttttggatgaatgaacaaaccctgaagatgctacatctgactctatatcttcattttatccttttcgtatttcctattacctctaatttctcttccctgcacccatttctatttatttcatcccagtttacctcctgctgccagattaattttcctaatgcacaggctctatcatatcatgagtttctcattgctacatatgactaatttgccaatatttttgcacatcagaatgtgtatcactttgaggctggttctgtgtttgttttagtttaggaaaagctgttcagattgtctgtaaatccgtatggggatctttgcataggattttaaagcagccacacatcttgtacaaaatgtataagattaattttctatgttaggaccatttgttttcaccaattccatagagctccaatgtgtaaaagaagacactgatctaactcttgtgttaaatatttagtaactcatttatctggaagaaagcaaaacaaaacaaaaatacaaggaataaaaatcactgggagtgcttttcattcactgaataatgagttttgcaaggagcacgtggatggtgacattatatcttttacatctttattttctgtttcttttttgactccttatcagtgaatttatcttattttatacttttactttctatttctttcttgactctttgttggtgaattggtagcaagagacttactgtctgatcagaactttgaatcttcctgcctctctttctttgaggttgacagggataaagataattaagatagcgcttgggtgtgatgacactggaagacaggctgggtcagggcctgtagtagagacttcccccctctattgaatgttaatctgaaagtgaatctgaaagcagatggtcatgaactacccagggtctccattaagcccatgaagtttattttaaaactcttaaaatagattgagattcaaattgagattcatgtctattttttaaacattgtgtcttaacaaagtagatgttcagtcatacagttaggcaaatgttctaaggaaagatgtttaccatgctaagttaaaaaaaaaaaaaaaaaa

SEQ ID NO: 2835 - DNA, 1927 bp, Homo sapiens
ggcacgagtctttacctgggtgatctatcattgcgcactctatgtccatgtgcagacattatttagctcccactttaagtgagcacatgctgtatttatctttccgtgtctgactactgatcacaagcctttagaagcccctattgcctatagaaaacaatccaaactccaccttagtctgatagtaaaggttccttatgctaaaacctcagtttaactttctagcatactctcctatttctctccttctacactgtcccaaaatagattattcattattttgctttcaatgtttcccatgcttttctgtgttcttggtcatttaatgcacttttcccgtgcttcatgctttccatctgtcagaattccatagctttcaaggccccttcaaatgtccctggtctcttcctctgcccctccctacccccaacaagcggtgtgtatacacatagtcccctggtggtgtgtgatcctctgtccagtacgtcggttctggtctggcttctgtcttttgcagacacacctcactatgcagtcacgaggcccttgaggacaggaaccatctctttcttcgaatgcacctttcccagtaggcacacggctgttattgaataaacacagatcctggacacttgctcaaattgacaaaatttgcaggagattcaaagtggaaacattttactgaagggaattcggcaaatacatcttgattcttgtataggtggtcagtttgtaaaggatcatcaagtattttgaagactcattggctctgccagtggcttagataaataaatttgggcaagttattgatctctctcctcagagaaaaaaattgatgtgttttcttttatataaagagaaaaagaaaaagaaaaaatgtgatctgtaactcattatgtttccttgctagaaagctcaaagatatgttatttgcctgtttttagttgctatccagttttcttacaataatctctctgcctcagtctcctcatcggattacttgtcacatgtgttaaatccttcttttaattgatggttctgttgtatatatcttttatatttatataggtagcctcaactctcctttttttggagagtggtaatagaaatataaataataaatagttgccctttggtttccccaacctgtggtgacaacaagataataaaacagatacttatcctatataaaacaggcaaaaaggctttgggacaatatgggaatcatgatgtgggtttggtggaaagcgagcaaagcaccttgtaaggatcttgtagtctgaagattaaggtgtgcttggggtaggtcatgtcctcccagctctgtgggatttgtagcacatcatcccacgtggggaggagagtgggcatgggcatgagactatttattagcttttactgtgtcagttgttgggttatgtattttgcatttgatatttaatttaatctttgtaatagccagagacttggatcttattggcatcattttccagatgagcagagctaataaatggcagaactagaattcaaatctgaggctctctggcattgaaaacaacaacaaaacatgtttctactcttcaaagagactttttctcctggattgtcacttgtccttttctttctctttctctcctgacattggtatttaaaatgagaacctaggaaacttgtttcttctaacctaatgtttttgaagcagttttaggtccttggagatgtgccttgatgtgtctatacaatatagtatttggtattgttagatataaagaagacctgaggccgagtgcggtcgctcatgcctataatcccagcacattgggaggccaaggcaggcagatcacttgaggtcaggagttcaagaccagcctggccaacacggtgaaaccccatctcttctaaaaatacgaaaaaaaaaaaaaaaaaa

SEQ ID NO: 2836 - DNA, 793 bp, Homo sapiens
gtgtggaagacaaatggtcacaacttgggagctcagtgcacgtatctaggtgactgggaagagggtggcaccaataccagcaacagagcaatgaggaagaggaaccggtttgcagcagaagaraaattttaaacgggttgcatttgagcagctttggaacatccacatggagataacaacagagagttggaaatgctagtctgaaccttaaggaggaaagctctacttttggcagaagaactggaacgtatcccctcttcctggagtgcctttccctcagctgtctcctttccggtcctcagtaaggtctctgctcaagtaccccttcatgccctttcctgccaccctacaatggtgcccctgtcacacacaccaccgccctcgctctgctcagttcttctctgcacctacctgagattttgcttattacctgctyccctyctcgagcatcacctttagagttgggacactagtctcaacttcctgtttgaaaaactgaacattaaaaggcaaccatgtcaagaatattcagaatttgagaccagcctggccaatatggcagggccccatctctactaaaaatacaaaaattagtcaggcatggtggtacatgcctgtaatcccacctacttaggaggctgaggcaggagaatcggttgaagccaggaggcagagggtgcagtgagccaggaaatgtcgccactgcactccagcctgggcaactgagtaagactttgtctcaaaaaaaaaaaaaaaaaaaaaaaactcgagggggggcccggtacccaattcg

SEQ ID NO: 2837 - DNA, 1943 bp, Homo sapiens
ggcacgagctagtctcaagtttttttttttttttttttttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaggaacaaaaagtaatgcaagactcaaaattttggagtggttggcatgcctctcttcattttactttttgactggctgcctgtatgccgatgatgatgtactgagctgtttgtgctgctgctgctgccatagccattcaaaaagtttgaaagctaccagggttagaaaaggacaacatagaaaatgaaataatagaaaagttagcagtatgattaatcttaagtatcaaatcatagacatttcagaataaatttagtatatggtctcctgttagttgggggtaccactgataatggaactttctggacacaaaaagagaaggagtgcattatgtatcaaagcactgaacctctcttctcttgcatctgtataaaatttgatattgatgctattttgtttagaagagtatattatttttgaaataaaaccaacaaagtaggagaagggagatggaagaaatccaaactattgtacaacaaagctggtagacagacaattgctttaaacaaaagatgctgcaatgaatatcagactactctactaacaataaaggtggtgaactgagactaagcattgtttgttatttttttagctgaatgggaccacagtaatcagttcaacactcattttacatatggggaagtttgaaggccaacatgatttaagtgactcagactcaaagttaatatggcagtctgtggctaagaacattctcatgatttttttcagactagagttgtttccactaaattatactacagctattttcggaaattcacaattggtctgataaaggtatatgattatataaacttctatttggaaattcactacctctaaattggaactttatatgtaaggataactgacttccaaaataaagattatcattctaaaagacttctaaaggcatcatagtaagcccacagtgataagatgctgacaacacagtcactcattcaatcctcaaactcttatcatagttttcttatacatatggcttactcttttaattaagtgtgaagttagaattatcgtcttcaactgacaggaagttagaattatcgtcttcaactgacaggaagttagaattatcgtcttcaactgacaggataatcattaagagtaatctttagttcaccatttactgctggaagtgttgagaagtaatttaatctttttttttaaatgataaaagtgacttacagaagttatgctattgaccattaagacttaagtcatttatgcaactacaagttaccagaacgagacaaaagattatgcaatctagaaaaattcagtcttaacccaggaaaacaaaaaagttattaattaagataactattggcaaacactgaaaacagctctggtaacctagtaaagtggataattattttgccagtaaactgtaacaaggaaacacaactgtggtaattatgttaagtcaaagctcttaatccactatcaatgaaaaaaaatctcagccatcaatcaatttaatagtttacacattatagctttactttttcctgtttactggttgcaagggaaggaaaagaaaataatttaa

SEQ ID NO: 2838 - DNA, 1479 bp, Homo sapiens
gctcgtgccggtttgggtctagttcacatgctcatccctggacctaccactgcgaccgtggtatcaggcactctggctcagccaaggttatatgcccatgtctctgtgtggagtgggtgaaggaggaggaagtaaatgatatgcagtttgatataatagcaaataaccaaggggaatagcaataaccaagggaaagggaagctgaacatttatgatatcctgtagtcaatacccccttaatttattttttgcatggcttaaagccagggctcttatttcccatttggggctttctgtttttttcttgagcttttaatgaacgtttacatttcatcagtttggatttctttgctgccagtgttggatatttgcttttttaaaaacaaaccaaaaaactatcatttaatatatccacctttctacttagactccatcttgaaaagaattatattggcccattggacacattttctcccaagatttaaactgtgaagtaagggatgaaaggatatgtgtcaatgtttgaaggaccaggcagggctgtggcatgtctttgcctgtgattcctatcaattattgtatcctggtttcagttttctagttctcttttgagtgggttctwatattctttcaggaaagtttatttttgctaataatggccagtgtcaatttccagtgctcacaagcaagaaccatgctttcagaaggttggtataagaaggctactgccattctcatgagacttgtaggactctttgacagtagagaaatcacagtagaaaaatacaacttctattgtttgccctgtatgttgcttccctttgatagcagggactcacattaaatgaagccaagaagttacattagagcctttgctgcccaatatgatattactagtcacagatgactgttgaaacctaaatttaaattagaattttaaaaaattaaaattcagtttcttcagtcacatgaagtacatttcaagtgtgcactagcaacatgttgctagtgactatcatattggaaggcacagattgtagaatatttccaccatcaaagaaagttctatcagacaacactgttggagtataaactcaagggtaggcattctgtccttgttattttctgatgtatccacaacacttagaatgggcttagcatgtataggtactcaataaatatttgttgaatgtcgaaatagcatatattgggaggccaaggcgggcagattacctgaggtcgggagttcaagaccagcctgcccaacatggagaaactccgtctctactaaaaatacaaaaaattagccgggcgtggtggtggatgcctgtaatcccagctacttgagaggctgaggcaggagaatcacttgaacccaggaggtggaggttgcggtgagctgagatcacaccattgcactccagcctgggcaacaagagtgaaactccatctctaaaaaaaaaaaaaaaaaaactcgta

SEQ ID NO: 2839 - DNA, 538 bp, Homo sapiens
ggcacgaggagttatcagtctggttagagctgggctaaacatttagtcttaccatcagtttaaaagcacctggaccagttagttgctgtacaggcaaagtcaaagggagaagcctggcctctctctactcagtcaaggttcatgactttaggagactgcaatgaaccaggcataccaggaaaggaaaaggttaactgaggttgaaaaaaaaactttatgtggcacttttaaacaagcaggttggtttggcttgtgtgactatgatggtgcctgattttgagcagagcaatttgtgttgtgacattttaaaatccattctggcacttggtgatgaatgtgttggctggcagctaagaacttgctagaatgcaagtatgcaagtcttcaccatttataatcgacacttcctttccaggaaagagcctttctaatctttgaatcagtggatttatcaatttgcataaaatatgccatcctcaatgaacacatttatcatctaccacttaactttccttctgttaaaaaaaaaaaaaaaaaa

SEQ ID NO: 2840 - DNA, 1090 bp, Homo sapiens
gcacaactctgggaggaagagtatcccaacctttgggtgaacaaactgaatctcaaatattttataatttatccaagctggtaagtggcagagctgggatttgaacccaggtctgtcttgttctaaatgccctgctttttttcactgcatcttcctcttgtgccatgtggttaaagataggcttcctttcaatattcagtttagttctattttacaaaacttcactaagcacctaccatgtgccatactctctggtgggcccagaggacaaagagatgtattagacctgacccctgacttgaggaactccatgtttaatggaaaagtagatgactgaccactaagatccaggatttaggtttctttcttgctacccatagaaatagcaatattgccttgtggatccctggaccattttcctcatgggaaggatatctttggcttggattaaaactgcaaagcataggataagaagtcagttctcaggtcactggttcacttagcttttttgtggctagaattacagccaagaccaggtccagccaggctgggcacaggtgtaggggatgtcaagctgtggcaccttagtgacagcaggaagcatggggccttcagtgcttggggtgaagtgagggtggttctaggcccatcactagctcacatggtataatgagaataatctagcagatttgagttcattctctggctttgccacttacttgtgtgtgactttgggcaagttactcaactctaagtctccattttcttatctagaaagtcgcactaggccgggtgcagtggctcacacctgtaatcccagcactttgggaggccaaggtgggtggatcacgaggtcaggtgatcgagactatcctggctaacatggtgaaaccccgtctctactaaaaatacaaaaaattagccaggcgtggtggcaggtgcctgtagtcccagctactcgggaggctgaggcaggagaatggcgtgaacccgggaggtggagcttgcagtgagctgagatcgcgccactgcactccagcctaagcgacagagcgagatccgtctcaaaaaaaaaaaaaaaaaactcgta

SEQ ID NO: 2841 - DNA, 2025 bp, Homo sapiens
ggcacgaggttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataaaaaaaaaaaaaaaaaa

SEQ ID NO: 2842 - DNA, 986 bp, Homo sapiens
ggcacgagcagcaaacagggaccacggctaatgatgtgctttttaggggcaggatgcatagagtttaagacttggactatggcctggattgcctgggttcaaatcctgcctctactctatcacttcaggcaggcaggtccttaggctctttgggccttctcatttcctcttctgaaaaggaaattcacctcgtgctgtagtaagtccgtgaattgatatctgtaaggcacttagtaagcactgtatactgtttgactatttgtcttagtctgctcaggctgccataacaagataccatagactggccaggggaggtggctcacgcctgtaatcctggtactttgggaggccaaggcaggtggaccactggaggtcatgagttcaagagcagcctggccaacataccaaaattccgtctctagtaaaatacaaaaattagctgggcgtggtggtgtgcgcctgttaattccagctactcggcagtctgaggcaggagaattgcttgaaccagggaagcggaggttgcagtaagcagagatggcaccactgtactccagcctgggtgacagagcaagactctgtctcaaaaaaaaaagataccatagactgggtggcttgaacaacagaaatgtattttctcacagttctggagactagaagtcccagataaaagtccagcatggtgctgggtgcagtggctcacacctggaatcccagcactttgggaggccaaggcgggcagattatgaggtcaggagttcaagaccagcctggccaacatgatgacaccccgtctgtactaaaaatacaaaaattgcctgggcatggtggcacatgcctgtagtcccagctactcaggaggctgaggcaggagaatcacttgaacccaggaggcagaggatgcagtgagccaagatcgcgccattgccctctagcctgggcgacagagcgagactccgtctcaaaaaaaaaaaaaaaaaaaaaaa

SEQ ID NO: 2843 - DNA, 627 bp, Homo sapiens
gaattcggcacgaggaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctcctggttatgaaattagcatcctcccagatctgacagctccctgaggggttatataaggagtagctcacttgcaaacataacatgatgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctc

SEQ ID NO: 2844 - DNA, 1220 bp, Homo sapiens
ggcacgaggaaagtctgaaattagcaagttatgaaattaaaaaatcatcgagatttaaaaaatatttttgggcttcatcttcatatgtgaagaaagtacgtgtgccactcacctgaaggaatgtctgcataagtattgcagtttctttaacccaacaaggtgtgattgcatttattcacatggacagaataacaaacccaaaactttatcgttcgttgatgagaagtgttagtcatttatttgaatgtcagttttaagctactgataacatgattgattagcaacggaaacattttagaagataccacgcatttgtttaattcaaatggtcaactgtcaggatacatcgctctcttattccactctcaccacaatctaactttaaaacattctcatcaccctaaaaagcaaccttggcactccccatcctccccttccatcgcccgtgccccaggcagcccctggttactttctgtctctgaggacttgcctgtcctgggcgttccacgtaaatgagtcagacctatgcagtccctgctggcctccttcactggcatatactcttttactggttcatttgtattgtagtgtatatcagtacctcatttctgtttattgccaaataatattccatcgtgtggatacaccacactttatttatccattcataagtgatggacatgggttgtttctactttttgcctactacgactaatgctgctgtgagtattcagggttctagccaatgcagttaggcaagagcaagaaggtggcgtccacattgtaaaggagagcaaaactctctctgtatgtgtgacatggtcatgtccgtaggaaatcctcaggagtcacccagccctctattaattaaaggggtttggtaagattgtaggacgcaagatcaacacacaagaatgaaattgtatttctgtatgctaacaacgaaccatccagagatagaattaagaaaacaattgtatttacagtgcatcaaaaaatatttcattgtgttaagacggcaacaattctagcttcttttatctataggttctgtgtaatacctactaaaatcccagctacctttgcataaattggcaagctgattctgaaattcacatggagatactagggattcagcatggctacaacgatcttgaaaaacaaacaaagttagaggacttgcaactcgtgatttcttctttaaaaaaaaaaaaaaaaaa

SEQ ID NO: 2845 - DNA, 657 bp, Homo sapiens
gaattcggcacgagagcctccacagcctgcaggtatccagacgacgttctgcacacagagactcagactcccaccagggcctcacgccccactgcctctccgggatgcctgcgtgtggctcactcccgccacgggcacatcagccctggtgcccagctggccttctgcagagcctggtgctggagcagcttctcgaattctctgctgcctcctccccacagccttccaggscctcagagctgctgccaggccagcacctccttgggcccgtgttgaggccccacggggctgggctcatgtgggagctgatcttggccgggtgatccctcactgctctggacaaaagggagccatgggccgggcatggtggctcacgcctgtaatcccagcactttgggaggccaaggtgggcggatcacctgaggtcggagtttgagaccagcctggctaatgtggtgaaaccccgtctctattaaaaatacaaaaattagccgggtgttgtggtgggtgcctgtagtcccagctactcgggaggctgagacaggagaatggcgtgaacccgggagrtggaggttgcagtgagccaagattgtcccatmmagcctggsygacggaggaagactctgtctccaaaaaaaaaaaaaaaaaaaaaaaaat

SEQ ID NO: 2846 - DNA, 1026 bp, Homo sapiens
ggcacgagcacaactatagattacagttctagatcttagtggtctgaattatgtggaaaaggtatacaccacacttcgaggattggctactttcactacaaaaaaatggagtcaccctaagctttttgtaagaagcatgtattgaatttgtaatcattgtaaagggtttaaaaaatggcatttctcaaaggatggctaccattttgctggagccaaagaagtatccattcttatttatgatttctggggcctccctgacccaactacttgttcaagacttttattttgacttagaatgatgtaaaaatgacttctgttttggtgaaggaggctgaaagtgaacggaaatgtttgtagagggaaataaagtataatgtgccattcacagatcattgaatagaacagaagactcccctttttaaaatgtttgctgctgcaactgtgtggtacaatgaaggaaaattcacgcttgcagatgctttgttcaagggcatttgtagtttccatgtgtgttcaactgacttctaaaggcctttcaaacatatgatcttgcctccacttcctgtgaaattaacctcctttctttaaaaatacaatgatttaaagaaaattgccaccataaacaaagctaaaagactaggggaaaatatttgctgcatatgtagtcaacaggattaccatctataatatataaagaggtcctataaattgaaaatttggccaggtgtggttgttcatacctgtaatcccagcactttgggaggccaaggcaggagaatcactcgagctgaggagtttgagaccagccctggcaacacagggagaccccatctctacaaaaattaaaaattagctggacatgatggtgtgcctgtagtcccagctgcttgggaggctgaggtggaaggaccacttgagtctgggaggtcaaggctgcagggaactatggtcacaccactgcactccagcctaggtgacagagcaaaaccctatctcaaaaaaaaaaaaaaaaaaaaaaaactcgag

SEQ ID NO: 2847 - DNA, 1535 bp, Homo sapiens
ggcacgagatcttagtgtttttgtatcggtcaaaaatttatctgactgaataattagaaataatttagggaagaatcacttaaaataacagtggcaaaaatactgtagaatgtcttgattggccatataatgttactcgtttttcctaaatgtttagtcattttttactgttcctttaactacagattacatttttttgtttgtttgtttttactgtcttcacaaatgcttccaaatatggctgcttccaaccctgagtttaacccaggaacaatactgcaaactgctcaattcagtagtgagtgggctatatgcatacctactcatcaaagctattatttaaagaattatattttttagcactcttagcatttcaagataatgcatgcactcagttcccaaagtgtattattgcttcttgaaactcctctttgatctgctgaaagtaatgatggctaccatcttaaacagaccctaaggttgagagtaaacatataaatttgaaagctgtttattgatatattgattatcagtggtcacttacctatcagtgaactttggtagtgacacatacagactggtatttataacgtgcaggcaaaataagtactgtgaccttgaaagattttttttttttttttgagacttgcactcaaaagattttttttttgagtcttgcactgtcacccaggctagagtgcagtggcaagatctcggctcagcctcccaagtagctgggattacaggcaccccactaccacacccagctaatttttatgtttttagtggggacagggtttcgatatgtttgccgggctggtctcaaattcctggcctcaagtgatctgcccacctaggcctcccaaagtgctgggattacagacgtgagctaccacacctggccttgaaagattattttctatttctgacccattatataccacccatactgtagtgcttgtattttctctcacacatactgtattttttaacttgagagagtgtatttggtagactagatgacagtctttttgagacagagttttgctcttgttgcccaggctgaagtgcagtggcgcaatcttggctcactgcaacctccgcctcctgggttcaaggaattctcctgcctcatcctccctagtagttgggaatacaggcatgcgccaccatgcctggctaattttttgtatttttagtagagacagggtttcactgtgttagccaggatggtctggatctcctgacctgtaatcccagcactttgggaggctgaggcaggaagttcacttgagcccaggagttcataaccagtctgggtgacatagtgacacccaatctctacaagagataaaaaactagccgggcatggtggtgcacacttgtggtcccagctactctggaggctgaggtaggaagatcacttgagcctaggagctcaaggctgcagtgagccataattgcgtcccggcactctgcctgggcaacagagggagaccctgtctcaaaaaaaaaaaaaaaaaaaaaaaaaaaaa

SEQ ID NO: 2848 - DNA, 1242 bp, Homo sapiens
  misc_feature (14)..(15): n equals a,t,g, or c
  misc_feature (1016)..(1016): n equals a,t,g, or c
gctcagattcggcnnagattttgttataaagataatacacacagagagaagcgcctgcagtgaatctttgtgtaaccatcatgcagatcaggagacaaaccatggcggcccctcagaactctgccacgtgtttcttcccatcttttcctgctgctgctcccagaagtaaccctattccgacttttctgggttttcttggtaatcaatttctggtttttctttatagagttgttgcctaagtatgcacccttcaacacgatactgttgttttgcttgtactttttgttaactgtacatataataaattatgttatatatttctttattgcaggctcctttaatccagtgttatgtttgggagacgcacccatacaactgcatgtcaccgtagcttgttcatttccagtgtcgtgtagtgtcccttcatgtgaatttatcacagtttattagtatcttccactctgatggacatttggtagttggaattttcattactaatgatgcccctgcctgtggtcattcctgcctgcctcttgatgcacacaggcacgcatttctgctgggtatgtcctagttccagactcactggttatacggtatggatgtaattattgttagttttccagtgtgattaaacatcagattagcgcccattagcaatgtctgaggctgcctgttgctccactcgggtgcccgtttggtattaggagcttcttcagccattcttgtgtttgtgttcatgtatctcattgtggttttaattttcatttctataatgactaatgtggttgaatatgtttttgtatgattatttgccatttgtatttgctctttttaaagtatttgtacaggactttcacccattctcttattgtgttgccttatataggaattatttctatgttctagatatggatcctttgctggccatatatgttgaaagtatctccactctttggcttgcctttcattattttaattgkgtcttgctgaacagaaggttttaatgtcaaggnagtttttagtcaatcccctcatttatgattggtgcattttgkcaggtttaagaagtcttttctttcccataagaacgtgaagaaaacatattctcctatgttttatagaccataggttggcaaacttttttctgtaaaggactaaatagtaaacattttaagctttgtggaccacagatagtctctgctacatattcatcttaaaaaaaaaaaaaaaaaactcgag

SEQ ID NO: 2849 - DNA, 633 bp, Homo sapiens
gctggtcaacatggtgaaccctgtctctactaaaaacacaaaaaattagctggacgtggtggcaggtgcctgggtgcctgtaatcgcagctactcgggaggctgaggtaggagaaatgcttgaacccaggaggtggaggttgcagtgagctgagatcgcaccactgcattccagcctgggcgacaagaacgaaactccatctcaaaatatgtatgtatgtgtgtgtgtgtatatatatatatatatgtatatatatatgtatatatatgtatttatgtatatataaatcaaaatgaaaaacctttttggatactaagagcaacaaaatttagggaagtaatttcttaagtatagattaaaacaaatatttatgcagcctggtgactagaaggctgttgtgtaactaaacaccatgaaacttaatattgcgatagtcctccccacatgaagagagagtgtgagtgatgaagggccatgttcttatatctattaaaactcaagagggaatttggttgcatatgaaaggacttaggtattataaagggttagatacttggaagaactgcaagtttaataagatgctgaaataagttgccaacagaaatgttggttattaaaaaaaaaaaaaaaaaa

SEQ ID NO: 2850 - DNA, 422 bp, Homo sapiens
ggcacgagcaggactgatggtgaaacctgaaggcatagacatgacccatagctgcctttatgttttacaacttcctgttgattttcattttcctcgtttgtcagtcatctcccttgacttcccacatctatctatgttgcatcctagcctggtgcctggcctggcggaggcattggaacattggaaagaatgaatgaatgagtttagccctctggagagtgtatgctgaaaaactgttacctcgcctttaagagcttaaaagtgaagagaatgaattttgatagaaccatttttttaaagtaaggaccatccttctgtgtccccagaaaattaaatagagtcagaaaatggcaaagccaagttagaagcattcaggtgtggaagttgtatagggcacttgagttaaaaaaaaaaaaaaaaaa

SEQ ID NO: 2851 - DNA, 535 bp, Homo sapiens
  misc_feature (11)..(11): n equals a,t,g, or c
  misc_feature (13)..(13): n equals a,t,g, or c
  misc_feature (162)..(162): n equals a,t,g, or c
  misc_feature (422)..(422): n equals a,t,g, or c
tgaaatatatntncatatggaraagggtctcccttggtcgctggatatggtttggctgtgtccctacccaaatcttatcttgaattgtatttcccataattcttaggtgtaatgggagggacctggtkgggaggtaattgaatcatgggagcccagtctttncctgtgctgttctggtggtggtgaataagtctcatgagatctgatggttttataaaggggagttccccgatcatgctctcttgcctgctgccatgtaagacatgcctttgcttctcctttgccttccaccatgattgtcatgtcttcctagccaagtggaactgtgagtccattaaacctctttttctttataaattacgtgggtccaaggccaggtgcagtggctcacgcctgtaatcccaacactttgggagtctganggcaggcggatcacgaggtcaggagttcaagaccagcctgaaccaacatgatgaaaccctgtctctactaaaaatacaaaaatttagccaggcgtggtggcacacacctgtaa

SEQ ID NO: 2852 - DNA, 2259 bp, Homo sapiens
ggtcgacccacgtcgtccggaagccaggagtcctttagaagtctatgattcccatcaccgcggggctggacagctctcttggggaccttccctgtgcacctgtgaccgtgtctgcccctcataacaccctagtcacaatgccctttcagttccccaaaaaagctagactggtcccacttctgggcctctgcctggagtattcacagaccctcagtcgggccccagcttggatgagtgtcagcagaggccctccccactccacctggattaaagcaggtctgcctggcgccctgcaccacacacccttccctccctcagcgtgtctggcccgaccagcacgcagcttccatgatggcagggcctggcctctcctgcacgccatgcaggcctggcccttgccaaccactggaccttagtaaatatttgaggagcaaaagaagcaaacgctagtgggtgcatgagtggtggcagagtctggttctgaggtttcygagcttaaggccgtgcagcagctggctctgctcccttgwkattctggtgcccactcccttgccaggtttcaggcacccgtggatgagcagtcagagagtctacagaacacgcacgacgacagcaggaacagcgcggcctcagccaggaataatccaggaagtgtcccggaaaagagagagaagacatcagagcctaaaggaaacagctgggctccgaacggcctctcagaagagcctctactgaaaaatatggatcatcacagatccaamcagaaaaatggggscgatgtccccacatgragggaacacccgacttagcaaatgggaccggtccccagggtcaggctcttagagcaggcacaagactgggacactggacagaaggttgttcccatgatggttttttttatttgttatttttgagatggagtttcgctctgttgcccaggctggagtgtaatggtgcgatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaactccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctgcctcagcccccagagtagctgggattacaggcatgtaccatcacacccagctaattttttgtattttaagtagagagggggtttctccatgttggtcaggctggcctcgaactcccaacctcaggtgatccgcccacctcggcctcccaagatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaaaaaaaaaaaaaaaaaaaaaaaaaaaaaaaaaaaaaaaaaaaaaaaaaaaagggcggccgc

SEQ ID NO: 2853 - DNA, 854 bp, Homo sapiens
ccacgcgtccgccaccccagtcccgcagccggcaccccgatcccacagccggcactcaccccagtcccatagccagcacctcgatcccatagatgacaccccgatcccgccccagtcctatagcccgcaccccgatcccacccgagtcccgcagccggcaccccatcccacccatgtcccacagtcggcaccccgatcccactcggatccggcagccagcttggatcctgtggccctcctccagcccccagggctcatttatatgttttattggcagaggctggggctggctctgttggcctctgtgctgggtttcttcctctgcaccgcagactggctctcctgacctctccaggtgtcatcgaacacccttgtgcttgctgtcacccgctgcctgtctgcaggatcccggattccgtatcaggggaccgaaattagtcggaaaataggaagcaggtgctcgcttggatggaaccctgaccctgtgctcacacttgtaggaggagggctctgcaggccgcctcccggaacgggaggttcccaagccactgcacttcggaggggctgtaattagagttgcacattcattcagttcccagtaaagtagaacgtgctccagccagtgaggaaaaggtgtttttaaaaattagattggccgagtgcggtggctcatgccttttacctcaacactttgggagacaaaggtgggaggatcacctgtggccaggagttcaagaccagcctgggcaacagagcctgtctctggggaagaataaaaaaaaaaattgagccttaaaaaaaaaaaaaaaaaaaaaaaaaaaaaaaaaaaaaaaaaaaaaaaaaaaaaaaaaaaa

SEQ ID NO: 2854 - DNA, 971 bp, Homo sapiens
  misc_feature (41)..(41): n equals a,t,g, or c
  misc_feature (564)..(565): n equals a,t,g, or c
  misc_feature (567)..(567): n equals a,t,g, or c
agtaaattaatgtaggaacagaaaacgaaataccgcatgtnctcttataagtgagagctaaacattgggtactcacggacataaagatggcaacaatagacactggggaagagggggaatggagggagggggcaagggctgaaaaactacctattgggtactatgctcactacctattgggtactgtgctcactacctattgggtactgtgctcactacctattgggtactttggtgacagcatcatacaatataccaatgtaacaagcctgaacatgtatcccttaaatctaaaataaaagttgaaattactttttaacaaargaaaatyccacatatttatattgaaaccaagccaagctgtggtcttctgcaatgttataatcaccctgtaaagtcaatatacaaaatatattgtattaattttaacatttctaggctattcaggttaaattttgkgttccaaatcwatctttcgtaatataagattcatattattctgatcacttctggctaaaccttaaaaagaattcccctatcaatacaaagaatattagttggganntnatatatatataataaataataataataatatataacataatttaaaaaaattttaatggcaaacagttgtatctaataaagattctgaatcctggtcgggtgctgtggctcacacctgtaatcccagcactttgggaggccaaggcgggcagatcacttgagctcgggagttagcgaccaagcctgaccaacaggagaaacccagtctctactgaaaatacaaaattagtcaggcgtggtagcacatgcctataatcccagctactcaggaggctgaggcaggagaatggcttgaacccgggaggcagaggttgcagtgagccgagattgcgccactgcagtccgcagtccgacctgggcgacagagcgagctccgtctcaaaaaaaaaaaaaaaaaactcgag

SEQ ID NO: 2855 - DNA, 1229 bp, Homo sapiens
ggcacgagctggggtggggctgagaagtccatgtaccgccagactatggtgagtgaccatagggtatgaccattatctctttgtaagtaagtcaatactgttccccacagatgaaacctcagagcatagaaacccatggattagcaggaaatgtcactgagtccattacaggtcagggatcactgaaaaatgtcattgctcttcgattgacactgctccctgcttcctcagctgctctgcatttgaggagaagccctgtgtgcctccagctgttgccaaggcagttaattaaacaaccggtccgcctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcacaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgccaaaaaaaaaaaaaaaaaaaaaaaaaaaa

SEQ ID NO: 2856 - DNA, 1260 bp, Homo sapiens
  misc_feature (15)..(15): n equals a,t,g, or c
  misc_feature (37)..(37): n equals a,t,g, or c
cccggtttttagaanctaaggggattcccccccgggnctgccaggaatttcgggcaccgaagtgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgygggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtcccyctccatgtccaggaaacttgtaaccacccttttctaacagcaataaagaggtgtccttgtaaaaaaaaaaaaaaaaaaaaaaaaaaaaaaaaaaaa

SEQ ID NO: 2857 - DNA, 1124 bp, Homo sapiens
ggcacgagggaatttgagattgcactgaaggccctctcagtactacgctacatcacagactgtgtggacagcctctctctcagcaccttgagccgtatgcttagcacacacaacctgccctgcctcctggtggaactgctggagcatagtccctggagccggcgggaaggaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccggtgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaaaaaaaaaaaaaaaaaactcgagggggggccc

SEQ ID NO: 2858 - DNA, 920 bp, Homo sapiens
gagcacctcaggggaggtgaaactcaggtggtcttgtggcatgcgtgggtgtccctctgcactctggcctctgtgctcttgggtgctggtgctgtgtcacacgccagggcatgtgaaggcaccacaggtgtgaacgagtccccgatgatgacctggggggaggttgagaacacacccttgagagttgaagggtcggaaacgccctacgtggacaggacacccggcccagcttttaagatcctggagccaggccgcaggaacggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtaaaaaaaaaaaaaaaaaaaaaaaaaaaaaaaaa

SEQ ID NO: 2859 - DNA, 489 bp, Homo sapiens
ggcacgagctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaagagcctccctctaatcttgtccatgcagtaaagagagatcacacgaaccctggacctacctctttgaggtggtactctcaaactctttgaagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgaaaaaaaaaaaaaaaaaaaaaaaaaaaaaaaaaaaaaaaaaaaaaaaaaaaaaa

SEQ ID NO: 2860 - DNA, 882 bp, Homo sapiens
ggcacgagcccgctccgtccctgctgccggtcgagggcacctccttttgggcagcggccgtgaagacccctccgtcgccgcccatgctgtgcgcggccgccattgcgaccgtggcctcctcgtgtagggagggtttggtgccgtgtgcggcgcagcagctgctggaggtgaagctggagcaggtgttgctgctaccacagccccacgttcctggcaagggcgccgcttcctctcccagcggcagttcaggcccgacctgcggctcctgctgccgcccgcctcttccgagggcgccccctgtaggcccgagttacacccggtgcagccccgggcgctgcacgtcaaggccaagaagtaggagctaggggcttgcctggacgcatcggtgaggcctcggggggccgtggagaccggtcgtagagcctccagggcggtcaagttggaaggcctcgggccggccctcgactacttccgagggaacgagaagggcaagctggaggcggaagaggtcatgagggacgcgatgcagggcggggaaggcaaaagctcggcggccatccgagaaggtgtgatcaaaacggaggaacccgagagactcctcgaggactgcaggctcggcgcggagcccgcgtccaatggcccggctcgtggcagcgcggaggtcatcttggccccaacgtccggtgcctttgggccgcaccagcaagacctcaggatccctctggactctccacactgcttcccctggggcccggatccagtttcaggaagctccgccttcagagctgataagattgaccaaggtccccctgacaccagtgcctattaaaatgcagtccctaaaaaaaaaaaaaaaaaaaaaaaaaaaaaaaaaaaaaaaaa

SEQ ID NO: 2861 - DNA, 957 bp, Homo sapiens
ggcacgagaggagatctacaagctggtggctctgggcaccggcagcagctgctgtgctggctggctggagttctcgggccagcagctccacgactgccatggcctggtcatcgcccgcaggcctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagcgacaagctggcacgctgggccgtgctggggctgggtggtgccctgctggcccacctggtgtccccactctacagcaccagcctcatcctggtgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggtaaaaaaaaaaaa

SEQ ID NO: 2862 - DNA, 1240 bp, Homo sapiens
ggcacgaggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2863 - DNA, 928 bp, Homo sapiens
gggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccaaaaaaaaaaaaaaaaaaaaaaaaaaaaaaaaaa

SEQ ID NO: 2864 - DNA, 2569 bp, Homo sapiens
  misc_feature (3)..(3): n equals a,t,g, or c
  misc_feature (2564)..(2564): n equals a,t,g, or c
  misc_feature (2567)..(2567): n equals a,t,g, or c
ggncacgagcggccctccactccctgactgtcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaawgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctggrctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgwactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaaaaaaaaaaaaaaagggcggccgctctagaggatccctcgaggggcgcaagcttacgcgancangc

SEQ ID NO: 2865 - DNA, 1192 bp, Homo sapiens
ggcacgaggcaccctgcagggcagcagctggatgaattcctacagctagctgtggacaaagtggaggctggcctggactctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaaaaaaaaaaaaaaaaaaaaaaaaa

SEQ ID NO: 2866 - DNA, 1507 bp, Homo sapiens
ggcacgagaattcactcaagttgtctcatctataccccttcaaaccctgtgagcctctaggtgctgtgctgtcctgaggcctgggccatggtgcccaaggaaagcccctgaagctcaccaggaggaagaagcatgcagggcactcctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctccgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggagagatatatagctggattgacaactttgtaatggagcattccgatatgtctcaaaaattcagattggcaacagctttgaaaaccagtccattcttgtcctgaagttcagcactggaggttctcggcacccagccatctggatcgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcgagccggaagtggctgccatagtgaacttcatcaccagcccatggcaacttcaaggctctgatctccatccacagctactctcagatgcttatgtacccttacggccgattgctggagcccgtttcaaatcagagggagttgatgtggccagtgggatcaccgtcgactgggcctatgacagtggcatcaagtacgccttcagctttgagctccggacactgggcagtatggcttcctgatgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggcaaaaaaaaaaaaaaaaaaa

SEQ ID NO: 2867 - DNA, 1129 bp, Homo sapiens
ggcacgagcgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctcaaaaaaa

SEQ ID NO: 2868 - DNA, 1003 bp, Homo sapiens
ggcagagtaaaaattataatcttagccgggtgctgtggcttacatctgtaatcccaccactttgggagaacaaggcaggaggatcccttgagcccaggagtttgagaccaccctggtcaacacagaaaggcctcgtctctatttattattattttttaaataaaaaaataaagaattataatcttgatgtggttaattgcacctttgtgtctattacctgtttctgttgcaggtgaacttaatagagcattaggtctgtcatcactctgtggagaaacagacatatatcaataattgttattcaagaagaaatactttctacttttatggtaattttgaaattataaaagacaaaaaacaggtaactctccttcacgattaagtctagaggtgagaatttgggtcaggtgcagtggctcatgcctgtaatcccagtactttgggaggctgaggtgcgaggattacttgagagcaggagttgagaccagcctaggcaacatagtgagaccctgtctctacaaaacgtctaaaaaattggtcaggcattgtggtgtgctcctgtagaggctgaggagggagggttgcttgagcctaggaattaaagactgcagtgagtaatgattgtgccactgcactccagcctgggtgacagagggagactctctctctccctctctctctctttttttgagacaaggtctcactcttgttgcccaggctagattgcaatgccatgatctcccaggctcaggtgatccttctacctcagcctcccaagtagttgagactacagggacacatcaccatgcccagttaatttttgcattttttgtagagacagtgtcttgccatgttagccaggttagtctcaacctcctgagctcaagcgatgcacccgcctcagcctcccaaagtgctggattataggcatgagttaccgtgcctggcctgaccccctttggaaaaaaaaaaaaaaaaaaaaaaaaaaaaaaaaaaactcgag

SEQ ID NO: 2869 - DNA, 1314 bp, Homo sapiens
cccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaaaaaaaaaaaaaaaaaaaaaaaaaa

SEQ ID NO: 2870 - DNA, 1703 bp, Homo sapiens
ggcaaaaagctaccacctgccagtctgaagcaccgagatgacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagstagtgcgkttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacaggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcacttccacccttcctgcaacctctactgcctgattagagtcctaattttaccctctccctccctgatgcataggtaaaggcccctctgtggagtaaggagatcttcagagctgttagtgtaactaattgagaagtattgtttccattgcgtgttccactcatgttgcttctcttgtgaaccattaactttaattggatattatttttacctgttaaaaaaaaaaaaaaaaaaaaaaaaaaaaaaaaaaaaaaaaaaaaaaaaaaactcga

SEQ ID NO: 2871 - DNA, 669 bp, Homo sapiens
ggcacgagccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccaataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgtctcttacagttctagaagccagaagtctgaaatctgcatctctggactgaaatcaaggcatcagcagaactgctccttctggaggttctaggagagaacatattccctttctcttttggcttctggtttgctgccagcatccctggcctgtcagcagcatagaataaatcttcaaggccagtgtcaaaaaaaaaaaaaaaaaaaaaaaaaaaaaaaaaaaaaaa

SEQ ID NO: 2872 - DNA, 1189 bp, Homo sapiens
  misc_feature (609)..(609): n equals a,t,g, or c
gccactacgcctggagggggtccctgctgctggtgtctgccctctccctccacctagtggcctgtggtgctctcctccgcccaccctccctggctgaggaccctgctgtgggtggtcccagggcccaactcacctctctcctccatcatggccccttcctccgttacactgttgccctcaccctgatcaacactggctacttcattccctacctccacctggtggcccatctccaggacctggattgggacccactacctgctgccttcctactctcagttgttgctatttctgacctcgtggggcgtgtggtctccggatggctgggagatgcagtcccagggcctgtgacacgactcctgatgctctggaccaccttgactggggtgtcactagccctgttccctgtagctcargctcccacagccctggtggctctggctgtggcctacggcttcacatcargggctctggccccactggccttctctgtgctgcctgaactaatagggactagaaggatttactgtggcctgggactgttgcagatgatagagagcatcggggggctgctggggcctyctctctyargtaagtggaatggggttnccagggggtgaagggctgccatgktgsacaactaggggagggtactawtctyattacagtgkatgtgaatattgscctctggtgtagtacagtacacagcctgsgkggccaaccatagcatccctgaaatgggtccatggggcaaagaacttggggctgggaaagtctgagtggaaagacaaaaagaagctaagtggaacccttggcagggtcctacggcttgggtttgcagaggacctggcagaacctggccagacacagacgtagcattccagtgtgcaccctttcctttggcctactgggccccaaaccaggtatctgaggcacctggtcaaagttctgctggctcagggtgccagaactttcagacctttatctcctcttacccattaactgaagctttagaaaggccacagttggtgggcgcctgtagtcccagctactcaggaggctgaggcaggagaatggcatgaacccgggaggcggagcttgcagtgagctgagatcgcgccactgcacttcagcctgggcgacagagcgaactccgtctcaaaaaaaaaaaaaaaaaaaaaaaactcga

SEQ ID NO: 2873 - DNA, 1245 bp, Homo sapiens
gagcggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctagcctccgctgcctatctagggtgtgtcatggcctggtgcgggaggctcttactctccccaagccccactgcttctcctgctgcccgcttgcttcggactctggcagaaaccccacctgctgacacgttcctcctggggaattggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcgtggccttcccgcgccgcggctaccccatgcaccgctctcattcaggaggcccagaaggccgagcccagctcgttccgcgccagcgtggtgccctgggaaacggtgcagatgtgcgcctccacctgcaacaggtgctgaagtcgtgctgagtctggccgcctgcaggggggtacccgggccaacggcggagggggcggggaagggagattcggcaaagacagctttactaaaaaaaaaaaaaaaaaaa

SEQ ID NO: 2874 - DNA, 2204 bp, Homo sapiens; identical to SEQ ID NO: 149

SEQ ID NO: 2875 - DNA, 2240 bp, Homo sapiens
ggcctgggcgacagagtgagaatctgtctcaaataaataaataaaattaaattataacaggcaaaccgtcactggccagggaactcctacgtggaataaacawagctgatgtgtaaagaattctgaggtgtgcttcacaggtcaccacacacagctagccttctgttggggtctggcccagccctgtgcttgggtaaggacagaaggctctgggtgacgctccgtgaaggagaacccagttgctgggcattgtctcttgtgcggtgatgctgatgcctatcctttggtctcatgcctggctctgctttgctgcgcaytctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaa

SEQ ID NO: 2876 - DNA, 2240 bp, Homo sapiens
ggcctgggcgacagagtgagaatctgtctcaaataaataaataaaattaaattataacaggcaaaccgtcactggccagggaactcctacgtggaataaacawagctgatgtgtaaagaattctgaggtgtgcttcacaggtcaccacacacagctagccttctgttggggtctggcccagccctgtgcttgggtaaggacagaaggctctgggtgacgctccgtgaaggagaacccagttgctgggcattgtctcttgtgcggtgatgctgatgcctatcctttggtctcatgcctggctctgctttgctgcgcaytctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagarccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttggtatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaa

SEQ ID NO: 2877 - DNA, 2240 bp, Homo sapiens; identical to SEQ ID NO: 2875

SEQ ID NO: 2878 - DNA, 1082 bp, Homo sapiens
ggcacgagcatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaaaaaaaaaaaaaaaa

SEQ ID NO: 2879 - DNA, 1913 bp, Homo sapiens
ggcggatccgacgcgcgagaccgggaggggacgagggcgttgcaatcgttcggggcgggggctttccggggagggggtgctcaggtgcaccagcggcggcggaccctcwgactctgccctcccctccctttaacccccttccagccggacgggaggcggrgcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctragaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccaaaaaaaaaaaaaaaaaaaaaaaaaaaaactcgagggggggtcccggtaacccaatcgtccctc

SEQ ID NO: 2880 - DNA, 1989 bp, Homo sapiens
ggcacgagtttttaaaagatatcttttgtgtagaagtaacccaggaatgccagcatttgttttgatagtctcattccaatagtagttactttaaaatgaagaatgttcttaatttacaaaatattatgtatgtatttaagttatgaatattgcagatatgtaaatatgtgtatatgtgtgttgattttaatttgtatcttcacagattttattatcagttatgttttgaatttttacctttggagaaaacatactacttaaatcttccagtgtagtgatagcaaattatctttatataaattttattcagattattcaaagtaatcaaagatttttaattatttttattaaattaaatttatcagtataaataattaagatcattaaccttatttaattaaatttattaattttgattatagaaaaatgcattttcttcttaaatagattctttacacttaaagctgaagtgttattttgctacttgtatgtatatcagatactttgtttattaatctaatacgttagtaataaaaggagtactttacaattattgcctgtatattttttcatgtgtaggaaaatgaagaagattatgggacctgttctagttctgtacaatatacaccagtttacaaattacacaatgaaaagggaggaaactcagaaaagcgtaagcttgctcaggtaagtaaggttatttacccttcattcccccacattctcaaattatataattccagtaaattatttaggaacaatttggatccactaattttttatcttatatgaaaacctgcagtattggtcaaggggaggagttagtggaacctgggaaggctacaaggggattgagagtcaaatgtttcagatatcggtttctacatgctttgttagcccatgccctcatagatctcatagtccagtgaaggaaaagacaattgaatgtgtgattcttatagagtgtgaatagcttgatgataaactggaaatcataggattcctttactacaaaaataaaatcaatcttatacatgggtatttggccattaaaatagtctatagaaattaaaatctgaactactataagtctatcctattctaaagttagattattttatttgctataaatagttaaagcttctttttatatgctgatgctacttaaaatattgtttcaagtgactgagtgttcagaatcatagctataagtgttcctggtttttttttcataagtacatttatgaaggctctaactaaacaaaattggtatatacaaaattgtatcttaagtggccttagaaaactagcttcaaaaaagaattcttgagtggactgtagctacaaaattacagaactggaagtggctgcaaagcttcatttataacagttgccaaggtttgcagatgagaaagttgatagctagaatggtcacaacacttgccataagtctcataactgatcagtggcagaaggaggcgaaaagccatctctgatgctcagttagctttcctggatagcccaggcaccacagaagtatacatggccataaggtgcttccagggtctttgtctttgagcccattttgtgctgctgtaccagaatacctgaggctgggtaatttgtaaagaacagaagtttatttctcacagttcgggaggctggaaagtccaagatcaaggcactggcaccttatgaggcccttcttgctgtgtcatcccatggtggaaggcagaaaggcaagagagatgagggggccaaactcacccttttataacagcactaatcccacccaagagggtggaaccctcatggcccaatcacctcttaaaagtcccacttcttaataccattacaatggcaattaaatttcaacatgagattttgagaggacaaaattcaaaccgtaacaacagtctttaagaatgggaaaggatagtgaagctgtactgaaactctagtcctttgtaaaaaaaaaaaaaaaaaaaa

SEQ ID NO: 2881 - DNA, 336 bp, Homo sapiens
gctcgtgccgatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgcttaaaaaaaaaaaaaa

SEQ ID NO: 2882 - DNA, 2794 bp, Homo sapiens
gcaggaaagtgcatctatcataagtgtgcaaattgatgaattctaaaatctttattgtacctgtttagcacmtagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcrtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgctttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattcmaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacrcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggacccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacawtcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagygccaccttgtttaatacatgggaactcactgaaattcattctgtattttgcccgcaaagttttaaagmtttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctytctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaawaaaaaaaaaaawaaagtcgacgggccgcgaatttagta

SEQ ID NO: 2883 - DNA, 2792 bp, Homo sapiens
gcaggaaagtgcatctatcataagtgtgcaaattgatgaattctaaaatctttattgtacctgtttagcacmtagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcrtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgctttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattcmaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacrcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggmcccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacawtcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagygccaccttgtttaatacatgggaactcactgaaattcattctgtattttgcccgcaaagttttaaagmtttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctytctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaaaaaaaaaaaaaaagtcgrcgggccgcgaatttagta

SEQ ID NO: 2884 - DNA, 3351 bp, Homo sapiens
  misc_feature (3250)..(3251): n equals a,t,g, or c
  misc_feature (3272)..(3272): n equals a,t,g, or c
  misc_feature (3282)..(3282): n equals a,t,g, or c
  misc_feature (3323)..(3323): n equals a,t,g, or c
  misc_feature (3335)..(3335): n equals a,t,g, or c
  misc_feature (3341)..(3341): n equals a,t,g, or c
gcaggaaagtgcatctatcataagtgtgcaaattgatgaattctaaaatctttattgtacctgtttagcacmtagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcrtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgctttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattcmaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacrcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggmcccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacawtcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagygccaccttgtttaatacatgggaactcactgaaattcattctgtattttgcccgcaaagttttaaagmtttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctytctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaataaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcaagctcattttttaaccaataggccgaaatcggcaaaatcccttataaatcaaaagaatagaccgagatagggttgagtgttgtccagtttggaacaagagtccactattaaagaacgtggactccaacgtcaaagggcgaaaaaccgctatcagggcgatggcccactacggtgaaccatcacccctaatcaagttttttgggggtcganngtgccgtaaagcactaaatcngaaccctaangggagccccccgatttagagccttgaccggggaaagcccgncgaacgtggctnagaaangaaagggaag

SEQ ID NO: 2885 - DNA, 2794 bp, Homo sapiens
gcaggaaagtgcatctatcataagtgtgcaaattgatgaattctaaaatctttattgtacctgtttagcacmtagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcrtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgctttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattcmaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacrcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggmcccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacawtcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagygccaccttgtttaatacatgggaactcactgaaattcattctgtattttgcccgcaaagttttaaagmtttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctytctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaataaaaaaaaaaaaaaagtcgacgggccgcgaatttagta

SEQ ID NO: 2886 - DNA, 1014 bp, Homo sapiens
agccaccctgctggttgcagtagagcttgtttgactatcttgtcccaagccctctgcacttccacccactccctccctctttccagaatttgggagcaggctcagaaaatgccatgccctgaaattccacctgataggaattgaagagaaatgaatgagcgattcccagcagggatcacttgccctaaaagatgaattgagccgagtttccgcagtgactgggtccttcccacacctcatcagtagactccaagccagaatgtaaatgaatgcaaagtgatctcattcactgagcttatccatcatggatattggtgccatgactgaaggcggtgttcttgtccaagagtaagacttgtgcatgtgcttttcccctccactttcctggggagggaatggcctgatgctaccgaccagtccacattctctgaacagatgcatccccagagtgcacgtgagttcatcagcttctccaggttgatggacacatggcctgtgatgatgtttctcaaagtgtatgccacacagaacactagttcgtgagttgctccatgaaccaagggtgccatggtcagataagctgggaaatgctgcgtgctgcaccttccttagcaagattcatgtgcaaaggatctgagaagtcctgtgataccaggcttaccaatccatttggtcacatcacacaccccactcctcactgttttttggtttttgttttttttttttgactaaacacactgtctcctagggacacagttctgtgtagttaacaggaaatatttattgagtttctatgtggcaggccctgaactaagctttcttttgtatgatttcatttgctccttaaagcaaccctgtgaaatttatatattgtcatcactcccattcgacaggtaaagcattcgaggcttggagagttcaagccactttccctcctcactcagccagtaagtggtagagccaggttcaaacccaggcctgcctccctccaaagtccactttatcatgcttccc

SEQ ID NO: 2887 - DNA, 1382 bp, Homo sapiens
  misc_feature (558)..(558): n equals a,t,g, or c
  misc_feature (763)..(763): n equals a,t,g, or c
  misc_feature (768)..(768): n equals a,t,g, or c
  misc_feature (976)..(976): n equals a,t,g, or c
gttttaggtaacaaatgtttgctgagcatctaatgatgatgacaataataactatgatctatggggcactggctatgggccagggcattgctaagagctccagatccttgatcttatctaatccacataagagcactatgagggaggtactgttatttttcttgttttacacacgaggacactgaagcagaatggtcaagaaggtggctcatggtccatatggggtacagccaggacccagcccatgatttcagctcccgtgcatgttccctccatccacagggcctggtgcagttctaggagctggggggatgaagaaaggaagccaaggtcttcaccctcaaacactcacagcttttgctggtagacacaaataagtaggcaattactagaagacatcaaagtgctgttttacagcaggggttggcagactgtttctgtgaarggccagacagtgaaggttttagagtctgcarggcargcagtcgctgtcgcagctcctcagsgcmaccactgcarctataaatgtatgggcmtkgctgggktccyattaaactntatttacaaaaacaggcctctggtgggattggtcggtgggtggargggtgtarcttgccccagttctggarggattggccaaatgttctgtgaggacgctgtartgaccctaaagagaggcacccaactccatcagggctcagggaargcttcctggagggggtggcscctgaatgagcatgagctggccgagacgaagagcagnctggntgaacgggtcgggtctcacaacacggtgctcatgaggaacgctcttaatgtgcacactgtcctgtgtctgcagagcctgctcgctcagcacaaagactttggagcagcttttgagcccctgcagaggaagctcttggacctccaggtcagggtccaagccgagaaggggmttcagcgggaccttcctggaaaacaggsccagctctcnaaggttgcaggtgaggggtctgtgaggcctgaatcactcctgcccaggtgctcagctgcacctggaagcagcgtctccctctagcagtaaccagcaaagcaacagctgccgtgagccagaaawttagacccttarttgagatctgacctttcacctcaacagaacctctgcttatttatctgatggttcctgacctcaaacaactgagtcttgagctcagcaaaatgacaaactgtctttctgtttactcctcagttccaaagtctaacattggtatttgtttttagaattgctttgctaagtattcttaatgagtccagaggtgttcagttaaaccaactttgggattaagaataaatgttctgaaacgtggactgtaaaaaaaaaaaaaaaaaaaaaaactcga

SEQ ID NO: 2888 - DNA, 1282 bp, Homo sapiens
ggcacgagtataattgaaaattatattagaatattttagactgacctcccacataaaacagaaatgccttctgaggcttttgtgatagttattcagcctttaattgtctctacctccactgaccactttgtcactacctcttgtgggagttattattcccaaactgtgtcattgaaaaggaagcctctcttctataaatcaacccttcaagtattttaagaatctttccaggtcacctttctccagactaaatacacccagtttcttaactttctcttgggtgatgtgtgttccaggtatgccaaatctctattatatagttttatattgcctctatgtcttctaaactgaaatgttttccattcagttttggctattatatagaagtctaaaagtctttaagttagattttctgccgaggaactgagaggaatttggactttcctggagtgaactggagaaaggagttactttagctgttgaaaatgaggtgaggctgggtagagaaagaataagaatcccttccacctggatatagggcagattggtactgaccgaggaattactggaattcttcagttgaccttgtttgttggaacatataaatgtttaaaccttttaactagagaatcagatacacatttgcatagtctatggcctttaatacgtaaggaatattcatttggctgtagcttatataatgaattggacaattatgttttttgtggacaaagatcctgaatggcatcaaaagtttaatttctttcatttcttctttgccagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagtaagtgagctaaagcatagagaagacctcttgagacagttcagtggctgttataacaaaatgccttcagaaaacaaaaagttcagtggctcttgccaaatgttagtctggtgaatgttgcggttagcatttaggactttgcatttgtattttttcccctaaaattgtgattcattcatttaaatagttttctgtgttattctctatactttttttgtattttattgtatttatttctttttctttttttctctttttttgagttggagtcttgcattccagcctgggaaacagagtgacaccctatcttaaaaaaaaaaaaaaaaaa

SEQ ID NO: 2889 - DNA, 1637 bp, Homo sapiens
ggcacgagctcgtgccgtgacatttgtatatatgtaaaggaagaccatctgtaaatttttccagttaaagtaaacaaaaaatttaatacgcaagtacaaacctgtgcagtgccctttataagtctttcgaagaagtactacaccctgccacatcaaatgttgatgatctgcttgcttagcgggagggcatttgcttactttttctctaattactttacttctactctgatcttgctgtctcagttctcctaccagcattgatacagtataaaagggaatattaagagttccatttagtaaaaggcttcaatctaaatgagatgaagggatatagaaactgtttttcctctgactaaagaaaaatgattgggatgatctgttaaagtttcgagaaactcaaataggccctatttgccaatataggacaggaaacccacagattaagtattggataatctcaaagctccttttggccaattggtgccagttttctcacccaccaatctttcctcaactgttaaaaaaaaaaacaggaaatacattgattgacatttgtcttctcttagctgtgctttgtttcaaagttgaaaaacaaagaaaaggagagaaacttacctcctgagtaatctaatcatgaatgttctaattcttggcagttgattttaaagaagaagccagacaggaacttttctcttcattttcctctaccaataaatagcaagtaaatatgtgtcatgtgattttcttcttgacatgtacttttcttctgctctccctcagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtaagaagaaagattgcctacatgtacaatgaagtaggataaaagtggatatatcagaatggaggagttatcagagaattagacagattaagtcgctcttctgttgctcctttaggacagctagcaaggatctgaaatgacatacatgcatcaatagtccacaggtttcaagatttctggcagagcctttccttgtcttagagaaaataaatgcattttgtcttctctagggccagggtgaattgatggtggtgggcctagtctggcatgggcaaggacaagagttgagttcttaaaaaaaaaaaaaaaaaaaaaaaaaaaaaaaaaa

SEQ ID NO: 2890 - DNA, 1522 bp, Homo sapiens
ggcacgagggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaagacgtgctggtgggggccgactctgtgaggcagccatcaccttcagttcttttccatttctcctggggtgttggcctccctgggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagctgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccataacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtcaaaaaaaaaaaaaaaaaaaaaaaaaaaaaaaaaaaaaaaaaaaaaaaaaaaaaaaaaaaaa

SEQ ID NO: 2891 - DNA, 1344 bp, Homo sapiens
ggcacgagctgaagaagaagccgccgcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcag

SEQ ID NO: 2892 - DNA, 1399 bp, Homo sapiens
ggcacgaggtatatcttgtctgtcagctaaattgtgtccttaagggcaggacctgtgtttcagacatctttgatatttaccatgtttgtcataaatttagtgaatgtacagtatattttggttttaggcgagcagtgtatctgtcccttttgctgcttgctagttctgccttacaacttccactggaaagagctttttagtgcagcaaatagtgtctgcattttattgtataaagcattgcctgggccataccaaatcattttgacagaggtcatttcagggatgccacaggcttcataatgctacttgatgctagttgtagcaaattgcacttgggttttggtagttgtgagtatagtgttgtctccttccaccccgccttgtgtgttaatcactgactgccaggaaatctctttgacataacatcctaaaaagtttttgttatcagtagggccctgtaacattttttttccttttctaaagcctatgccttcaaattttttacaagtgtcttattccttctaaattgagaactaattgaatattttttcttgtagataaatcttattttaaatatctagttatcattactttgcattctccttttctgattttatgttacattaccaatatcttatgatatttaaacttttttgaactctgctttttaaaataaataatataaatgcctcaattatctggaacttacactgaaacactgtaatcttgtctctgagcctgcttcccctcaaaaaatttagatttagcttttcagatgcttatagctagccaagtaagtgagaataaacacaaaaaggctaaaatatgcaagttccggagttgtcaaagcttcatgtaaaatgtgtcattgtggaatttaaaaaaattctacgctttttcatcaaggtttttggttggggcatttagacacttcctgaaatctggcattctcctaggcactgggataccatggagaagaggcagatatggtcttggctcacatggggcatataatcaagcagtaattcttaaccttggacagacttgagtccattatgccaatggtcatctccactttgccatgccattttagttttccctaagtaaaaactacgcctgtaatcctagcactttgggaggccaaggcgggtggatcacctgaggtcaggagttcgagaccagcctggccaacatggtgaaacctcatctctactaaaaatacaaacattagctgggcgtgatggcgcgtgcctgtaatcccagctactcaggaggctgaggcaggagaatcactcgaacttgagagacggaggttgcggtgagccgagatcaagccactgcactccagtctgggtgatagagtgagactcagtctcaaaaaaaaaaaaaaaaaaaaaaa

SEQ ID NO: 2893 - DNA, 3261 bp, Homo sapiens
ggaaaaagctaagcaagtgcttaaaataattgctactttcaagcataccacctcaatctttgatgactttgcacattatgaaaagcgtcaagaagaggaggaagccatgcgtagggrgagaaatagaaacaaacaataaccgtatgargatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactcaaaaaaaaaaaaaaaaaaaaaaaaaaaaaaaaaaagggcggcc

SEQ ID NO: 2894 - DNA, 1594 bp, Homo sapiens
  misc_feature (1090)..(1090): n equals a,t,g, or c
actcgtgccgaattcggcacragggaaactttggaagttcattcttaaaaattttataagtaatatatgagtacgtttttatgggatattcaaaccacctactgtttttaggtcttactctcttrtgwtgcagctgttgctgatccctgtagagtaaagtacacactgaaggctatggcaatgatctaccgttccagcttcctctaggaagggagtttgacaaataaaatgctagtgaactggagcacagtgagcaagggggaggtggcatgagctgaggacacagtgggcaggccagaacacacaggcctggacatcacctcaggaacttgcatgttatttggagcataatggaaaaccattagaaagttttagggagtggttatgatttcatttatttatattttataaagatctttctggttattcggtgaatagttatggttaaaccagttcaacccagtgacagtacctgtcacatagagttattgtgaggattggttgagatgtatgtgatagattatctggcacaaagtaagggccccctcaatattgtttttctctcaagtgcacccaaattggggtattggaaacacttcctccgtagtttggtagaaggcaccaaatcactagggctgataccgtttgagtggggccccagctgatggggcagggggtaaaggggtgaggggcttaatatgaggcagaaggaagggccaggcctctagaactcatcccaagccggccccattctctggctccctgtacatcctgcctttccatagaggaagccagtcccaggggtggctgcatcttattccatgcttwacatctcatcagccttgctgactttccccagcctgctgtagatcagagtgaaatctgtttttcctgtctagagcaagcgcactttttcctgaggatttccaaatattttgaattcccatatgcagtggaagccgaagaagctggagggagagtggggttgggaggtgcagaggttccatgtcttcttgcctttatgaagcttctggcattgtgctgggtgcaggtgatccatggaataagatggatgtggttctagtgacgnttcacatcacgaaggaccatctgtgtcctcttagggagtctggctttcctgctaagggcaacaggaaggcattgtagggtctgtgccaggataccaagtgaaggaagagatttccttactgtggacttgcagacgataagtaaacttttgggtcataagagaccatctcttggaagctgaagaacttaggccaaggttttcctgagaaatctagttttgcagaatgttgtgaaccttgatgctctggtgacagtgaattaatggtttattttaggaagcactacacaattttacttaagagtgaggctagaaagttgagctgtttctcaccttttataaatgaagtttaagatcagattaatctccatggagtttttagctcaaagcacaattagttttctatagaaagggcttgggctgaaccaaattatgccattgatctgcctggtagacatacaaatcattctgttcttagaaaaaaaaaaaaaaaaaaaaaaactcgag

SEQ ID NO: 2895 - DNA, 1455 bp, Homo sapiens
ggcagagcccaagctcccttggactctgtatgttccaactgcatactgtgcttatgctaatgaatttcgttgttgccttgtctgtccctctgactttgaagacagaggcagtgagtacagatgtttgacacagtgcccagtacatatatgatcttaatatttgttgactattaacatcgttgttattgttaataattatagaatgtactgttaactttttttaactttttaaaaaatcttgttttttatagcctcaaggaataggttctcctagtgtctatcatgcagttatcgtcatctttttggagttttttgcttggggactattgacagcacccaccttggtggtaagtaatcttttaaattatttaacactgactccaaaatctcttcttcttcagttttggaggaaaatgtgggccttttccctttgcacggttaattctcccaccagtattgttcagtattcaccagtattttactggttgtcttttccaactgttaactctcccttacctttttttgggaggggggtggcgtggaggtgtttgaatttggacttgtcactgggcatgttcaagcagaggctctgtaactactctgagtaaaatggaagagattcttaaaccgacaggtttagaaaagatgatgtctgtgacctgcatgactcggcataattactttsaggttcatttatgcagctgmctttmcaaaarcaggtttctgttcatttgggctaagtacctagaagggctattctttaatagatctaagctgattttacccaaattctcccaggtttgaaactttagaaaagacctccctgcccgaccaaacaactcagaagatagccagttttcttatattggtgtagataaggggaatggaaggagggaaggactatctatggtaaatatctataccatcttgaaaggagtaattatgataaatgtacagtttaccaaatcctagaggaatagagttttaaagtaatatactatgttttcatgaaggtttttataaaaaagttatttaatagaaaaattatgtaagtagattgaactagcctaagaacatttacagtacatatttcttgatatatttattgacagctgtgtaattgttactatctatacataaaatattgatgtttagcagttgcttatgcctgtaatcccagcattttgggaggctgggtgggcagatcgcttgggctctggagttgagaccagcctgggcaacatggtaaaaccttgtctctacaaaaaatgcaaaaattagttgtgcatggtggcatatgtttgtagtcccagctgctcgggaggctgaggcaggagagtcgcttgagcccgggaggcagaggttgtagtgacccgatatcgtgccaccacactccagcctgggcgacgggagtgaaaccttgtctcaaaaaaaaaaaaaaaaaaaaaactcgag

SEQ ID NO: 2896 - DNA, 2020 bp, Homo sapiens
gaattcggcacgagccgcmttaactttaaattcggatacttttaattctttggttatggtttgttggttgctaccactgtgggtcactgtcttatccttcccagtagggagagatgtggctgctcttctgattttcacctcctcttactaatttaccctgtggtgggaaacacatcaactgatagtgttatttcatgttaagtaaaggcaaatagccaccttcctcatttgactgaaactcaatgtgtcacattctacctcttttcttagtccttaaagacttctgtcatctgttagtctgcaggctcttaaggtcaggctctgtcttcccttcatctttgtagcttctactcttgtgcttccctcttgatgtaggccctgaatcactgttttgttgactaggagagcacatgaactgtttgtgcaacctctcaagctccgttagaaatggaagatgatcatacmtcytgtggcacccctttttcccagatcccaagcttccgggcaccctttctttcttcacctccacagatgctgccttcacccaccctttgatgaaccatcttgatcaactgccaagaatgtcaagggcatttctaacgccagggcaacagctatgagcacttatgagaccacatcaggtttgactcctgaacgaaggatgtccttawccatggkcyctttttcctggcaggcatcttgctgttattttggaaattttctctgggccgtaraggtttgaaccagtcatgtctaggagcgtttgttttctcaggaaaagcaaccctgttaaagccattgttttaaaaagtcacttggarcmttwaaaacctttgaccatccattcataaggctaaaatttagragtggggcttcaggcaagcaatattgaattaaatgtgtggagcactttaagmcagcatttgattgacatttaaaatagggaatgcaaattgaaattcctcctgggtgctttaaatcatgcattatatgtgcagtattttcaattagctgcagaaaaaaatatgttcggtgtggctgtatttttacagctgggaattgctcagagamcmcaattgactatttcatccatgtgagatttatttaaatgactcgtggggcatttgcagtttagccaataattgaaaatattgttgcaatgtggcaggtaaacctaggaaatcatttcgcattcctgaagaggtgttccaagctcagcagcatattatattagttgaagaggggcaaacggagtgagatcagtgttgagttctagtctttcacatttcattcctgggttttgccccaccatggaaatatatgggatggtgctttccagaaggacctgaaacgctaaggtgttatcttgtttctattctgtttttatatgccaamcwcaaatgaatggtcagaccagatatggaaagacccatctatcccccaactctcttctgactcctatacctttctttctatttttcgtaccatttcacttcagaagtcacctggaatactgatgcaggaggctaagctgagtctctcagggtagacagttcaacctttctatggttgttcataaatattactagggatttggaatgcatgttcccactaaaatgatgtaaatgtggttaggtgataccatattaaaatgcatcatcacttgtgcgattcagacaaagtatgggttaactaggcattgtgaaggcagaattaaaatactaaccaccaccactttctctgtaatagtggttgccaaccaggggtgatccttcctctctccttcagggacatttgtcagtgtctccagacatttggttggtccatctgggtggggtgctattagcatctcttgagtaaaggccaggaatactgctaaacattctgcaatacacaggatagccccctacaatgaataattatccagacccacatggcaagagtgacaaggttgtgaaactttgctctagaaatgtgtacattcttttttttaaaaaaaaaaaaaaaaaaaaaaactcga

SEQ ID NO: 2897 - DNA, 1774 bp, Homo sapiens
gaaaggtacctctagagctgcagcctgaaactgtacattttaaataaacccttgggggttatcatgcccagtgaatttgagaatggccctcaggtgaatagactgatgctgggacagcagcagcccgtggctgatgtgctgagcttactgcatcccctctctgtgcccccgggctccctggagcaagatggagtataatcccgccagccaggattttaggacagggacatagccctccgaacgatggtggaagtcagtgggtgccacatgggatgaagactgagagggaaacccttagaattggctgggcgtggacaaagcggggaaaaaagtactgaccaaactcacttcagtcttggagaactcaaggaacaagggacacacatacgtacacacacacacaggcatgaacacatcagacacatccttcagcctgcatactttagcttcagatagacttttcttttactagaggcaaagtgatctcactagaagaatgtgttcctcaggagctgctagatggcctgtcgctctgtgcccgctcactgtggacggctgccccacgtggatgtccataccacagtgggatccacggcctcactcaaaagagagctatggttcccagatccctgacaagagggccacaatctgaaaaggggttcctggttagctcttttaggcttagcctgagaacagaattagcctcatatttttaggccatttgccatacacattttctctcattctcaactgatacgggtggggggagattttcgaaaacagtgatgttggtaatttatagttagtaaataaaccatgtttccatatgcaaggattcacaccaggggatcctgcccacaggtatctggaggtcaaattcgtatgtgctttctgccaatctgagccactgcctctgtgtctctgagaataatatactctgcaagaaggaaagacgcacaagcaatagtgcagtcttcttagcaggcggaagtcagcacggtgtgccccctgtgtaaggggagttgcgctaagcaatgtgtttggtgattgacagattctctgccccagattctggttacctctgattagtagatgcggacatggaattaagggtaattgaaggatatttatcgagtcagacatacaccttagaataaggcttttactgttctagaaacaatattccagaagatgaaatcatccaggatgccccaaaaatatttatttatacaaagattttgagagtaatattcatacttgtctttatacctcagtctatgcgtctggggccaagtcactgtgtggcacatgtgcagcttccccgaatgcctcacatgttgtagcacctgcttccaggaacaccaaatgaacacagggtcttggaggggaagtgggggaagaacccataatgccccaaggctgcatggaaccacaatccagaaatgtgcatcctgacctggaaggcgtctaaccaagtgtccaaggggaaatatgatcgagggagaggtgagaggagggacccagagggcagacaggagagggttgatttccaccctttcttctgcgttcagcatatccaaaaggcccaatacagttgatgggccaggaactgcatgacctggattttctccctgtagtgacccacgatgttaattgatgtagaggacagtttgcaaaagtaatagatttgcccttaatcmcagacagtatgagatacaattctgggactttgtcttcgtaacctgtctttaaaaaaaaaaaaaaaaaactcgag

SEQ ID NO: 2898 - DNA, 1619 bp, Homo sapiens
gtttgtaataaaataccagtgaaggacatgtttggatatctgttaagcatttttccctgactaatgaattaggaaagaaaacataaaacataaatgaatagttatgtctcttctaataaacagtgtcattaatgctgcagttgtgggtcaaacttagggagccttatttctaaatagcaaaaattctgttttcacttcagcccttattttttttgttagtttttctctgcactgtgatacagagctaataagaggaaatgtgacgtttcagagagagagcaagcaaattgggtatgacttttttaccctatgttccccaatactggggatgtttggctactttgaacagcagtttttagtgatctaaagtttagatcaatactcgtataagagaaaaatctaactctcagtgagctccatagggcagcacagctttccatcttctctttcgccttcttgcgtctgcccaccacagtcccgaagaatgcacacgcacatatgatctgtacccatcccgcccgaagagtcatagaatcctcttctttcacttgtttcttttttcttcgtttgtttgtttttgtttgtttgtttttttaagctggggaccactgaagtaagctctatatgcacccaaagttccccttggaaaaattttcaacacgcagtgcagaaggctccagtgcagctaaatgccacaccattggttctacctgggggaatagactgatttgccctaaaatgactccaacctgcatcattaaggtacagttggctccagtggattagtgctgaaatgatgggaagtctgacacttgttgacattgtcttcatctgtttggaagggttgaatctgttcctctcaacagtgatagttcttttcactgtatagtattgagtatgtctcagggattccttgtggaaattagggcagtttttaaaataagaaaatagttttaaaagaaactaaaggtgactcatcattgaagagagcggaagaaagaggaaacatttggttttgtagcccacagtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttgacgaaaacaaactagtaagcacctttttacactggatctgccgtgtcaaggtgtatagctatcctttgctaccttgcagatatataaaataaaaggatatcctggggcctcaaaatgtagaaccctttagaccatttataactgttcctagaactgttgagaatcatgttctttagtaaatgatctgtggtttacacttaagatggctagaagcttagttacagggtttgttaaaaaaaaaaaaaaaaaaaaaaaaaaaaaaaaaaaaaaaaaaaaaaaaaaaaaaaaaaaaaaaaaa

SEQ ID NO: 2899 - DNA, 1921 bp, Homo sapiens
gcagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtasctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctrttggttggacagygttggtctatactgactcttatttctcagggagatcacagcaacctaaataaaccagataccttttcaaaaaaaaaaaaaaacaaaaaaaaaaaaaaaaaaaaaaaaactcgag

SEQ ID NO: 2900 - DNA, 1920 bp, Homo sapiens
gcagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtasctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctrttggttggacagygttggtctatactgactcttatttctcagggagatcacagcaacctaaataaaccagataccttttcaaaaaaaaaaaaaaaaaaaaaaaaaaaaaaaaaaaaaaaactcgag

SEQ ID NO: 2901 - DNA, 2206 bp, Homo sapiens
ggaccacttgaagtcattgaagggaactctctggagatagtggagttcttagtctctgccctttgttcttaaaatattcagctgcattttaggtaaggtagtgatctgccttcaattgcaaatagttgataatatcacttttaatgtagactaaagccaacatttttcatgtattgttctatttggagtaaataacacattttggcatggttcttcatgtcttagcatctgtcagttttcatgtgaggactcagtttacaggttatatacagcacatgttgagcgtggtcagtgggtattgtacctgaagtacgtacttcccttctgttgctgatattgtcatgagcagttccaccctcagtgtttacctctatgctttgaaatcttctctcaaacgcatattcattcctawtttttgtaccctttgggattcctcaatctcatatacatctttccatttctgacctaatcccagcactttgggaggctgagccgagcatagtggggtgtgcctatagtcccagctactcaggaggctgaggtgggaagatcacctgagcccgggagctggaggtttcagtgagctcagatgtgccactgcattccagcctgggctacagagcgaggcctgtctcaaaaaaaaaagtctcatgacttcgtctcctagatgaraccatctctagctgatgcctttgcttgcattctcatgtgcagggccagcagatactgatggarcagatgttctctgargctgtaggtgctggggcacaratcttttcctcatcctactacctartgaargggaraaatgacaagcgaagcaactgcaggtkaaaaktgtttggagaggtttctatasggctccagtctatgcactgagcccaggcatagacttcagagatgcttcctgaaaagaagttggcaagatatgagggaggagggcgcagctcctgattcctctgacctttctattgtgggtttgatgccccctccccacctgagtcctcatgggcagctgtgttttgtttttttttgttttgttttgttttgtttgagacagagtctcgcactgtcgcccaagctggagtgcagtggtgcgatctcagcagctgtgtttttaagaagtgtttctactcctttccttactcaatcctgaccctgtaaaattcccacttgctggctgccccctccccaaggaaaggccgccctctgcccctccacagtgggtggtgcccggagtcaggggacaggtctgggctttcctattcttgctgacccagctatagagaccgtgctctttcccattcagagagtcatagctacttggtttttttttgkttgktttgktttgktttgktttgktttgkttgtgtgtgkgkcttttattttacgcttggggktgkctttttaaaactttcttttawtcttttatcttgggawaattacytattttaaagwaagccttgkttgkttttgkctgktaaaaatctttacagccatccagcttatatcaacttttttatttcctgccaggcaaaaagaattaatagaaaatggcagcccaagaggtaagatacgcagtctgtccacaccccaracagggcaggataaatgcctttcttggttctaataagccctgaagagatactccctgtagcaccaagtcatttccctctgctgcccctttgaggtgactgtattcccaaaagtagtcagtgtagaggaatggatggcccgtttaggataggtagttgcacagattatctctgagggaggtgactaagaagctgaactccaaagacaagacaaaggaattgatgaacagtatcattctcttaactctgggatagggattctgtgaaggttaatgtatgctcttttttctagggagaagatccctttatatttgattgtcctggggatctgtggcccagagtaaaatcagcagtcccagctgtatagactttcaggttcattatggttgtgatctgaaaaccttggtcacctctgtggtatgtgtcattggattctagctacttgagtgaagtggctcctgtgcattcttagaagcgagtatgagagaggatggggtggagttccagttttactagagaaagctctcaaaagagaattttgatacccaacttgaaacctggaaaattaccaagtacagcttcgtgttaaaaaaaaaaaaaaaaaactcgta

SEQ ID NO: 2902 - DNA, 2597 bp, Homo sapiens
  misc_feature (588)..(588): n equals a,t,g, or c
gagatttaagtcgaatgccctctttaaagggaacaaaagctggacctccaccgcggtggcttagaaggaggcattgtttatttattatatattttgtaatgttattaccaatcttgttatactctttcttataccctacaattgttagcagaaattattttaaattaataagatcctgcatgcttttccttaaaaaaaaaaaaaagaaagaaagaaagatctctgtgtagagtgtcctattctgagccagtcctgagaggaaaggaagtataatcaatttgttattaaccgatgaaagaattaagtgaaagataaatctcaggaagcagaggaagtaaacctaatctctgactaagaaagctaaatactatgataactcatcattccttcttttgttcaattacattatttaatcataagtccatgacgtgccaggcactcaggaaatagtaaaaattggacgtgcgatattctgcccttgtgtagcgcacactagagtgggaaagaaagtgcacttttaactggacaactaccaacatgatgaggggaggaaacaggggctggaaatgtccacggactgtgccgaanaatgaagcccataatatttgaaagtcagtttcttccatcattttgtgtattaaggttctttcttcccctgttctccgccttcctgcttgtcatcttcactcatcagctgaccatgttgcctcttgtggtgtaaacttgtaccagttttacggtccctctggccagttcacccatgaatttgatggagatgagcagttctacgtggacctggagaagaaggagactgcctggcggtggcctgagttcagcaaatttggaggttttgacccgcagggtgcactgagaaacatggctgtggcaaaacacaacttgaacatcatgattaaacgctacaactctaccgctgctaccaatggtatgcgtccaccattctgcctctctttacttaagctatcccttcataccagggttcattattttcttcccaagaggtccccagatcttcttatggcaattgctgaaattttatcatctcccatctctaaaatcacatattcccatgtaatacaagggtctttccattatgcattcagcaaatccttctaggagaggtctcatcaacctcctactttattaaacatgcccacagagagaaggcacaggaataaagcagagcaatgtgtcattgctcccaagcagaaggtaaataagacctctttgactatcaggtggtgaaatgctggtaggagggctcttccaggatgtaatgcagaacttcagggcagagctattcacacttcacaccagtgctgtttcctcaccacagaggttcctgaggtcacagtgttttccaagtctcccgtgacactgggtcagcccaacaccctcatctgtcttgtggacaacatctttcctcctgtggtcaacatcacatggctgagcaatgggcacgcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactggggtaaggatgagtttcatcattttttgattcttttctgtctcacttttttttttgaaagaataaagcaaaaaaagcagagatttattgaaaatgaaagtacactctacaggatgggagtgggcctgccacttcatggttttctaaatgatagacttcactctcctccctaagctgggggccttgagtctttgtagagccaaccctgtaccccatcccatcccacacacatgcacatgagcaaactctggcattctgacctcaacaacttcacttccacagagcctgagattccagcccctatgtcagagctcacagaaactgtggtctgtgccccttggggttgctgtgggcctccttgggcattgtggtgggcactgtcttcatcatccaaggcctgcgttcagttggtgcttccagacaccaagggcccttgtgaatcccatcctggaagggaaggtaagattgagactggttacagttgaagcggcagtatgaaaggaaggaaagtgggagggcgttgtggacatgaatgtggtttaaagttgtaggggaattgggaagtggcatgatgatgacacaggacccccctcagacccattgatctcatgtctgccctgttgcaggtgcatcgccatctacaggaacagaagaatggacttgctaaatgacctagcactattctctggcccgatttatcatatcccttttctcctccaaatgtttctcctctcaccttttctctgggacttaagctgctatatcccctcagagctcacaaatgcctttacattctttccctgacctcctgattttttttttcttttctcaaatgttacctacaaagacatgcctggggtaagccacccggctccctaattcctcagtaacctccatctaaaatctccaaggaagcaataaattccttttatgagaaaaaaaaaaaaaaaaaaaaaaaaaaaaa

SEQ ID NO: 2903 - DNA, 1075 bp, Homo sapiens
ggatgactagaatcccaacactgtattttctatcttccttttgttttcttgtattttaaatacaagaaagtttaataactgaaaagttcaagagaattgcccaggtgtacaagaattataagtgacagagctataattaggaacacattgttaatgacttcaattcacttttgcttctaatgctgccctgttatctttgctgtcattatcccttattcttcccatcttaaagaaaataacaagaatagtatataamctgtaaatamcacatttatgtttatgattgttatatatgaaaacaaaggcttgcatagatggcatagaaatgggctttattaaacaattgaaacatagtgagagataaaggaaagtcaccacaaagccttgcttaatcatcagagtaagtggactgatgtcaatttagctccccttgccctgttaatcttctctaggatgttgatgaaaaaaataagtctgacagctacggttctctgtggtcattgtctatacgtatttctccatggcttccaccagtaataatcagaggcagttgctttgtttgatgttatgtatagaatacgtaatatcagcattgtagaaatggtactttgaaaaaataaggtagtataaatcaattaggaggagcacaggctttggtgtcagtgcaccttagtttgaggtctgtttgtttgtttattttgagacagcctgggtgacagagtgagaccctgtctcaaaacaaaaggattattagaaagtaccatgcacaggccaggtgcggtggttcacacctgtaatcccagcactttgggacgccgaggcgggcagatcacccgagttcgggagttcgagaccagcctgaaaaacatggagaaacaccctctctacaaaaatacaaaaaattagccgggtgtggtggctcatgcctgtaatcccagctacttgggaggctgaggcaggagaatcacttgaacccaggaggcggaggttgcggtgagccgagatcacgccattgcactycagcctgggcaacaagagcataactctgtaccaaaaaaaaaaaaaaaaactcgag

SEQ ID NO: 2904 - DNA, 2778 bp, Homo sapiens
ggaattcggcacgagaaacgttaaagaaatggagaatgggaacttacctggttggcactgtagttagtggccatgatcttgtgctgtttacactcgttgcttggcaactgcagaaggccgacctcctgggactaccaatgagcagaggctgcctttctcttctgcttattattattcacttccttggctcacactgcccccatttgttttctctggaacttagattcatttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcatttgtattgtggggataatagagcctgcttttacagggtaagtgagataaaatgaataaagtgtctagacaatatcatagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaaatggtattgtaatacccatctatgaggtggttaggagaattaataagtaagtagaactgtgctttgtgaattgtaaagtgaatttatatataaggtgtcaagatgaaagggaaaaactaagaaataagttgcccaaagatatcattaggaccaggagaccattataaagtatatccaggccgggcacggtggctcatgcctgtaatcccagcactttgggtggccgaagcagacggatcacaaggtcaggagttcgagaccagcctggccagcatggagaaaccctgtctctactaaaaatacaaaaaattggccaggcgtggtggtgcatgcctctaatcccaagtagttgggagtataggcatgagctaccatgcccagctaatttaaaaaaacaaattttttttaagagatagggtcttaactatattgttcctcttgtcttgaattcatggcctcaagtgattcttcgacctctggaagtgttgagattacaggcacgagccaccacacccacccaacatggtatatcattgttttaaatttgcatttctttaattagggtgtttttatatgtgtataaactgtttttattttaatttttttccctgaaaatggcctttaatgtattttgccacttactattgggctgttgacttttttttttgaaaccagtcctccctctgtcacccaggctggagtgcagtggcatcatcttggttcactgtaacttctgcctctcaggtccaaacaatcctcccgcctcagcctcccgaataactggaactacagggatgcaccaccacacccagctgattttttaattttttttgtagagatgggattttgccatgttgcccaggctggttttgaactcctgggctcaagccatctgcccacctcagcttcccaaaaagctgggattacaggcttgagccactgcacccagcctgttgatcatgttcattaatctgtttgaactccatatattaaggaaattagtcctttgtcaaatatgttgcaaatattccctccaatttgtcacttactttcattttgttggtggtttttctgttttgttgttgtttttctgtgggtttttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactgatttgaaatgccatttttaatgtattccctaacatatttgggtctgtttctggatcctctaacccactgttctagagagaaaggtgatcgttttagattatttgtctctctgtaatctaaaatccaaggtacacgctgggcacagtggctcacacgtgtaatcctagcactttcggaggctgaggcaggtggaacagttgaggacagaagttcgagaccagcctgaccaacatggcgaaactctgtttctactaaaaatacaaaaattagctgggcatggtgacacgtgcctgtagtcccagctactcgggaggctgaggcaagagaatcgcttgaacccgggaggtggaggttgcagtgagccgagattgcgccactgcactccatcccccgggcgacagagtgagactccatctcaaaaaaaaaaaaaaaaaaa

SEQ ID NO: 2905 - DNA, 1904 bp, Homo sapiens
ggcacgagcaaattacagatttaaaatgttagttaatttggttcaaaacctctaagcattcaactcaccagactactttttcgtatttaaaaaatgtttaaagatcaatgaagttggagattttctttcccactgtttagaatttttgttgtcagctgtttaattttttaattctgtagaaagtagaataatagaagtgtgttggtttcggtaaaagtaggcatggctgccatgctcattcagagttgtagcctctgatttcccaagacagtgttaatagggggcgtgcttctcgtgtttttatagacagtgctcatttacccatactaatggctttgaagtatatggtatgattatttttgcaccacatttaactttttgtttgtattttgcttaagataatattaaagttcagctgtgatttctaagtacatactaacaggacaatgaggcacagtaacctagaagcattacatgatgtggatgtgggtggaatggggccctgattaaaaatmcaatgtgttgttggcamcacagtaagcagatacyccaaatatgcataatctggacttaattmcagaattggataaagcagtagcttcattttgcagagtagtggtcatattagggaggccgaagcccaattttgttggttatctaaaccagggaagaggagatttcaaataatttcagaacggtctcttgctgcctctcaaaattcatcaagaccattcctttttgttggggtcctcaaaagagaatttttaaattttttattattaaaaatttcgaatatgttgttacaaaagtagagggagcaatgtaaaaacttcatgtactcttatgtagcttcaacatttaatagtccatagccaaccttgactaatttacatctttaatttctccccagctccatgcctcaaattcttttgaaacaaatctcagactccatataatttcatttctaagtatttcagaatgtatccctaaacgatatgaactcttggagtttcactcttgttgcccaggctggagtgcaatggtgcaatctcggctcactgcaacctttgtctcccgggttcaagcaattctcctgtctcagcctcctgagtacctgggattacaggcgtgcgctgccatgccaggctaattttgtatttttagtagagatggggtttctccatgttgatcagcctgggaatcatagcaaaacctcatctcaaaaaaatatttaaaagttagccaggtgtggtggcacgtgtctgttgtcctagctactggggaagataaggcgagaggattgcttgagcccaggagttcaaggctgcagtaagctatgattatgccactgcacttcagcctgggcaacagagcaagaccctgtctctaaattaattagttaattttaaaaaaaatactgtttttttgtattttattatcttcaatttataggaattaatatgttatttttcgtattgatagtgatactgttctcttttcaaataatgtatttaagctttaaaatattcagcatggccgagtgcagtgtctcatgcctgtaatcccatcacttttggaggccatgcaggtggatcacttgaggccaggagttcaagatcagcctggccaacatggcaaaaccacatctctactaaaaatacacaaattagctgggcatggtggcacacacctgtagtcccagctactcagggggctgagcgtgaggattgcttgaacctgggaggtagaagctccagtgagcgaggtcacgccactgcaccccagcctgggcaacagagtgagactatgactcaaaaataaaataaaataaaaataaaatattcagcaaatagcaaacagatagtgtgcactgttgtggtaaaaaaaaaaaaaaaaaactcgag

SEQ ID NO: 2906 - DNA, 1918 bp, Homo sapiens
  misc_feature (9)..(9): n equals a,t,g, or c
  misc_feature (28)..(28): n equals a,t,g, or c
taacgcctnccttgacggcctccacaangcactcttcgccactcagcgcagcttggagcagcaccagcggctcttccacagcctctttgggaacttccaagggcwcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggycaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaaaaaaaaaaaaaaaaaaaaaaaaaaaaaaaaaaaaaaactcga

SEQ ID NO: 2907 - DNA, 1768 bp, Homo sapiens
  misc_feature (1277)..(1277): n equals a,t,g, or c
  misc_feature (1327)..(1327): n equals a,t,g, or c
  misc_feature (1364)..(1364): n equals a,t,g, or c
  misc_feature (1478)..(1478): n equals a,t,g, or c
  misc_feature (1543)..(1543): n equals a,t,g, or c
  misc_feature (1554)..(1554): n equals a,t,g, or c
  misc_feature (1639)..(1639): n equals a,t,g, or c
  misc_feature (1649)..(1649): n equals a,t,g, or c
  misc_feature (1653)..(1653): n equals a,t,g, or c
  misc_feature (1655)..(1655): n equals a,t,g, or c
  misc_feature (1668)..(1668): n equals a,t,g, or c
  misc_feature (1671)..(1671): n equals a,t,g, or c
ggcacgaggcctttaaaagcttctgctctttccaacccagcctgaaggggaaagccacctcggaggacaccctcaatctaaggtaatggcgggtagccatgctgtctgggcatggcactgccctgggctttgatgttcctcctctggcctcatcccactctaaagaagtcttgcagagagcatgcccaactgtttccctcatttttctctctcctattcctatacatccttcatcctactcctggaattccttctggccagttaaacctctgtgaaacagacttgaagtcttcacatgccctgtggctttttcaaacccaagtggcaggaagccatcctctgcctttggtgactgggcaggtggcacagaggtgtggagtcaggcccagccttggaggtcaggccctcccgtgggggtgtgtgagcaatcccatgctgtccctcctgtgatgagggtttctgaacgcttagaagctaaattcatacaagttggtgtgcgaatcacacattaatttaggaatctgtgctatggggcgtctctcccagtgaatgaattgcttgcagtcccccccgccgccgccaggtcccctttccagctacccagttctctggaaggccacttagggatcagtaggtgtttttatttcagtcggggtgagaatagaagaaggtggtagctggttttctacaggaatgtgtggggaccaatcaagagggtgtccccaggaatgacattcaagatatttataatcagtataaaatgggtctcactaattccttcaaaattatttattaatagcttgtgatacatggtatttgcttgttgatggagcaacaagcaaatagaaaaaaaaaatcccctgtccttattgagttcacattctcaccaggaggacagacataaaccaatataaatgagtgaactataaagcatattagataattataagtgtaagtgtaaaaaaccaagcagatagaggtgggcattgaaatcttagatgaggtggcaagcgaagcccttatcaagaaaacaatctttgaattaatacttggccgggcgtggtggctcactcctgtaatctcagcacttggggagaccaaggtgggcagaccacctgaggtcaggagttcaagaccagcctggtcaacatggtgaaaccctgtttctataaaaatacaaaaacttagccaagcatgatggcaggtgcctgtaatcccagctacttgggaggctgaggtgggagaatcgcttgaacccaggaggtggaggttgcagngagctgagatcgcgccactgcactccagcctgggcgacagagcaagactntgtctaaaaaaaaaggtggagaaacatgttatgcagntaattgagtaaagagtgtgtcagacccagggaagagcaaagcaacaacaagtacgcggccagcagctacctgagcctgacgcctgagcagtggaagtcccacagaagctacagntgccaggtcacgcatgaagggggccccgtggggaagacagtggccccttcagaatgttcataggntttaaaccctnaccccccccccggggggcttgagctgcaggatcccagggggggggtttttcctccccccccaaggcattaagcccttttccctgnactcaattancccncnataaattttctcnttntcaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2908 - DNA, 2196 bp, Homo sapiens
ttttttctttgttgactagaacctctcgtccctcttgactttcatgggcatccttctgatatttatcatttaatgtaatatttcccttaggctcctcatatgttatcaaataagatttttcctgtctatttccagttggtcaagagctttattttcgttgtcggttgctgtttgtttaccttaggtggaaattagattttcaagtactttggcctttgatactaggtatcaataaagatggtaatatatatgttctctatttatctgttaatgtggtaaatatgttaccttaataggtatctttaaatttacctgtcttacattcctggattaaatcttatttggtcatatttttaactattcagctggatttatcaagattttatttggaaaatttgtacctatatttataaataaggttctgtagttttttcctgatgtcttttttcattttttggtatcagagttattctgtccccatttttcctaaatataaagcttgatgttctactctttattgattttacattctctctgagtaatatctggtcttaccacttcaattatatgtctccttataccattttatcacctaatattctgtcagaggaccctatgtaggcagctatggttgatatttcaaatgttttcagaagacacagaagaaggagaaagaagaaatatgtggataaaaccagtgttttctattcataacttatgtaacatatatagctgactatgtttatggtgtctatcataaaaatgtataaagatagtcttttgatatattaagttgtatattctgagaaagtccttttttgtgtatgtgtatatttatgtatatatgtagtctgtatatgttttcaatacccatagcccttttcccactgaactggacggaaccttattgccattacaatgttttttcagagaagagtgttaatgcaataaagaaaagttaagtttcttttttctgagttctaagtaggctcctgaaacttctagttggcttaataatcttgacacacaagatagtgtatttcaagcagctgagctatatgaaatagaaaagggttttgagtttttaaaataaagctctgaagatatcagtgcataaatttatttttattttaacttttaacaacagattggaaagaaattagccaaagagtgagatgatctcatcacattattaaataagtgttgccttggttagaaggggagttgaaacaaggttcaggagacatggcagccctgtgttctgcctttctttcctctacagcctgagaccagggataatgatagaagctccctttagttgaagatttgagcattggagatttgtgcttcactctccaggtgaaagccaggggatggcaagcgttatctaaggcccctgtctgatgatagtgtgctggtggcagagttggaatggctgcacagcctgcttcttctggaattttgtgaagcaacaatgtcatgggtgtgtcccatattgaatgacatggtatcacttagatggagatggttaactatatgagagaagtctgtagataaagcaggtagaagatagttagcaggctcctatgggcccaggaaggcagttgagacttcatgcacttttgggcagaacaagggagctggatgcaagaccagtgctttaaaggacctcacagtaatgttgagaagaagccaggaatggtagtatggattacatgattagagtctactaagactacagatagttcactgaaaacccgatcacacaaatgctgtgactagagacttgacaggtgccaaatcagagtgctacaggtccaatgcctctcaccgataccatgcggctgctgtgtgaacttccctcaccacgtaaccctcaccttagggaagagaaggatgagaagtcatgaattcttaagatgagcatatgcagaaattactgaggaaaatcagaatgatgtaagcttatctagaaatgactagattatgttttctgatacttggtgctacagaagcatgagagagaggaggtaagttctattgcagaaaacagtatgaccaggcacagtggctcatgccctataatctcagtactttagaaggttgaggcacaatgattactcaaggccaggagttttagatcagcctggtcaacacagtgataccccatctctatcaaaaaaaaaaaaaaaaaaa

SEQ ID NO: 2909 - DNA, 1561 bp, Homo sapiens
atgtcagaggcattttaggttcttcatgtttctcccactttcagttgattaccattacaggatcttaggcttctttttatctttttgcagtgccttgcatccactggttgtttgttttttctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaamcaagaggctcatttagcagctttctctgattgccatgttcatcctacactmagcctcattcagtttacagcatggaaactgtataggacctctttcctatagaaattgaagmcacttaaataggaagaaaattaaaatatacatttggatacatgagtattccagtcaaataatatctataaaataccagatagagtataaaagacaactgamggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcaratgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatarcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaacttaaaaaaaaaaaaaaaaaactcgag

SEQ ID NO: 2910 - DNA, 1963 bp, Homo sapiens
gattagatattaaacacttcaaccacataagaatattgaggactgttgaatgagtcctgtgctctggtggtcctggaacttaattttatttatgaattttcagtcattagagaagagtatggtgtggatatgggaggttggattagccgactaaactttgaagtttgcaactttagcagatgttgggatagaagttaacacagtagttcaaattgatttcgcacttcatggtttatagaaatgctttcacattcatatctgaatatttgaaacaacctagtgggtaggtaggtaagcaatttkatctgtgtttcccatggaagaaactgaggctgggagatgttcattgtttgttatccaaggtcatatagctagtaagtagaagagtccagatgcaaacccaggccacctgaacaatgttcacatcattttaccatggagaagagattagtgcttttatttgtctaacactctggtcagtgaaattaaagtatctccgtgtgaaacagcatgcaaaaggctttgtttctaatatttttaacaaatccctttagatcgttgggaattaaacaaatmcctagggcagtgtggacttacctgaagtcttttgacattttatgaagttctgttaaacctagaaataaagtcaaataaattttttattgctttagagacatagttattggaagttatttatagtttaaatatgtagccataataattattcgtgmctatatttcaagatagtttattcagcaagcacttactgagaacctaccatgtactgggcactgtgttcttaaaaggactaattgatgagctcagtctagtgggggagatgagtaaaccagcaattataatacagagtactacttgagtagaggtacgcatagggaaaaccctgtaatagagggagcactgtctgtgttacctaatgcagacttgaggtaattcgaaaaggcatgttaagccatgtgatgcttgagtacaatcttgaaagcatgttaatacttaacttggtaagaacattttaagcgaataacagcctatgcaaatacacagaggcatttgagaatgcggcacttagagggagctacaaatagattgacatggcaagagtatgcactgactgttaagggatggaaggagttgagaccagagagagagagacatgattaggattgtgaagagccttagatgacatgcttttaaaaagttagtactttttcctaaagataattgggagtcattggtgaattttaatagggaaatgcttgctatccatttatgtttgcaaagattacataatagtgtggaggatggaattggtggtgcaggatatgagattggaagcaagaataccagttagttacgatagtaaccatgtcataaatgctccacgtccaaactggtactgacattagagagaaaagaaagaaatttgagaaataattagaaggttgagatttaactagtcttggtgagagagagagatagtcttcagatgtggtttggacaaatgggtggatggcgatgctggtcaaagccaatacatggttgaaaaagccggtttctgtggctagagggtgttgatgagctcagtttgagatattttgagttgaaggtacctgtgggaatttacggttagaaataactgttaggaggctgggcatggtgtctcacatctgtaatcccagcagtttggaggctgaggtgaacagattgcttgagatcaggaattttgagaccagcctggtcaaagtggtgaaaccccatgtctactaaaaattcaaaaattagctgacatggtggcgggcgcctgtaatcccagctgcttgggatgctggcttgaacctgggaggtggagtttgcactgagccaagatcacgtcactcactccagcctgggcgacagagcaagtctcaataaagaaaaaaagaaaaaaaaaaaaaaaaaactcgag

SEQ ID NO: 2911 - DNA, 1300 bp, Homo sapiens
ggcacgaggttatttgtattttacctggcaaccctatgttggagcctccttccctgctgcagccaacaggggtagaggatctgagctgcttatttgtaactgaaagtccatgggactgcttttatttgggggaatttttctgttaactgtcattatgaaagtgatcacgatgagagattcagatttatttttaaaattcggtggaggaatatctcctcattgatttagatctttgatttttttcatcagaggttttgttttcctgctatagattttgcatatcttttgttagatttatacctgagggttttgtctttttggagtgtgtgtgtgtgcacgtgtgtgctaatgtgtttttaagttcaaatttattgctggcatatagcagttgatttttgtatattatccttgtgaaaggagcaaaagacctgatggagctgttgtttgggggcctttcatcctacctcatcacttctgcaggacagccccttgggaagcccccaggtcacttgttttggggctcctgaacgtctcactagttggccacaggaagtccacttgaagtttttaaaaagagggcgtatcattgttttgatgcctcattcccgccaggtttttctatggccccacatggtcacagcttttgaactgctttttgctttttggctgcattgttctccgtgagtggtgggttcagtcctggcttcatactgaaatatctgcaaagttttaaaaacaaacaaacaaacaaaaaacaaacaaacaaaaacacccatgcctggtctggttggggggtgtaacggagcttttttttttttttttttttttgttctccaggtgattctacagcccagcttgggttaagaacatcttccctaaagtctcaaacaccaaaatcccctttcctgtccaaaaaaaaaaaaaaaaaaaaaaactttttagggcagttagtccatcttaggtaaggaaggaaggaaaactgattaaatgaatgtacactaaggtataagtagttgctagcccaactctcctgagcccctttttccctcctgccacaggcacctgccaccccgtctctactaaaaatacaaaaaataaaataaaataaaataaaaataaccaggcatggtggtgcatgcctgtaatcccagctacttgggaggctgagacagaagaatctcttgaatctgggaggcagaggttgcagtgagccaagatcgtgccactgcactccagcctgagtgacagagcaacatcctgtctcaaaaaaaaaaaaaaaaaaaaaaaaaaaaaaaaaaaa

SEQ ID NO: 2912 - DNA, 1146 bp, Homo sapiens
ggcacgagcccgcctgtaatcccagctaccggggaggctgaggcacaagaattgcttgaacttgggaggcagagtttgtagtgagccaagatcacgccactgcattccagcctggccgacagtgtgagacggtcccagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagctttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactggcatatataaatccactaaatccagctaccaggaactgcctggaactgtggccatgcatttttttttttctttaaagaccagtgtgatagtaggccatgcatctgagatacgatattccttggtaactagagggagaaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtaaaaaaaaaacg

SEQ ID NO: 2913 - DNA, 1472 bp, Homo sapiens
cccccgggctgcaggaattcggcacgagcagtacctaaaatagtggctggcccctatgtattgggtcatagcaggtactacattcacctctctactatgtttaatacagtttatttcccttgtgtgtgccttgctaaaatatttatgtttaaatttctgtatttgatacacattgtgaaaggacattttcaagtctaagtcccatgacttgagtttgcctgtgtctcccattaaaagctctcaattacaccattgtgtgcccagtacctcgcattgtgcctggccagtgttggacagtaaataaaaattcagtgtcttattcactgaggtatagtgcctaaaacagaagacattccataaatatgtgtggaatgaatgacttaaatatttgattaatgaagtttaagttgagcaaagaaaggagaactagtagcttagatttactaagaatactatgccacatttatttgtttatttttagagacagtcttactctgttgcccatgctggagtacagttgtatgatcatagctcactatggactcaacctcctgggctcaagcaatcctcccatctcagcctcccaagtagctgggactacaggaatgcaccctcttccctggctaatttttaaatttcctgtagagatggggtcttgctatgttgcccaggctgtcctcaaactcctggcctgaagtaatcctcccatctcagcctcccaaagtgctgggagtacagatgtgagccaccgctcgtggcctatgctacatttattttaacatctttatcgttcacaagtaatttcacaggtatccccttacttgagtcttgcaacaactctatgaggtttattttgccagatttatagctgaggaataagactcagaggagtcagagggcttctctaagattatttagcttgcagattggaacttgaacccaagccttgactcctaattttatatttgtatgaattcatacaaatgtcataggaaattatccacattttataactagaattatagaattagaagtggcctcacacatcacaaatcctgaacccctcactcatttttcaaagaggaaaataagaattggaaagtttatatatgtatccaaaggtacacatccagtttaggaatttcaaaaagctggctaggcacagtggcacatacctgtaattccagcagtttgggagcccgaggtgggtggatcacctgaggtcaggagttcgagaccagcctgaccaacatggcgaaaccccatctctactaaaaatacaaaactagccaggtgtggtggtgcacacctgtaagtaatcccagctacttgggaggcggaggcaggagaatagcttgaacctgggaggcggagattgcagtgagctgagattgcaccactgcactccagcctggacgacagagggagactccgtctcaaaaaaaaaaaaaaaaaaaaaaaaaaaaaaaaaa

SEQ ID NO: 2914 - DNA, 1117 bp, Homo sapiens
ggcacgagaattaatctaggctcttaacctttaaaaaatgtatataatgtttacatatgtttataatgtcacgccatttatttcatttaaaattttaaatgattttatctttggtcctctcttacaacttattcttggtacaacttattctttgtactataacagcagagatgagtaattgggacagactagcctccaaagcataaacttatttatgatttggccctttacagtaaaagtctgctcatcccaggttttgcttgtcaatttatatactggcgtttgttcctgatcctatttatttatttctggcatccaactctggtagttctttctgaatcagtttaatgaagtttgtaaatgatgtaattaaacgttatttattacttttatttttttctagagatagggtcttgctgtgttgcccaggctggtcttgaactcctggcctcaagtgattctcctgctttggcctcccagagttttgggattacacgtctgaggcattgcactcagacacttttatctaaagtttatatactgttaaactaaagaaaccatatacaaatttcaagtcaggtgcttttactcattttataccttgattcttgaatggccagattttctgaaaatacccagttaatgattagattatgctacttcagtcaccacgtgtttgaaggctgatcacagaaaactagaagcaatgtaactagtttcaaaatataattaaatggaggaggaagtgtttggcttttttccctccagaccacaaattggtaggtaaagtaaaagttagatttgaaaattgggcctgggtgtggtggcttacacctctcagcacgttgggagtccaaggtgagtggatctgttgagtcccagagtttaagaccagcctgggcaacatggcaaaatgccatttttactaaaaatacaaaaatgtagctgaatgtggtggcgcatgcctgtagtcctggctacccaggaggctgaggtgggaggatcatctaggcccaggaagttgaggctgcagtgagccatgataatgccactgtatgccatcctgggcaatggaaatgagagacccccgtctcaaaaaaaaaaaaaaaaaaaaaaa

SEQ ID NO: 2915 - DNA, 1797 bp, Homo sapiens
ggcacgagctgagagggccatggagaatctgtggccagccctccctggccccctgacctggcagaggaaggaaagggcattggagtaggcttctgtcttcaggccagagggggaggtggttcaggggcaggcttggtgcaccccttggctgcaagctatcacctccctatctgcttcctcttttctgcctcccctggtgcatctggtcacttcttgctgcccttcctgtgaaatcgtggcaccttggaccaagtcctgaagcacttgggcagaaggcgggagaggttgggtttctaggatccttgtttcccagggcctggctctggcctgggctcagaccactctggtctaggcaggctgctggggaaaggctggagctgcttctgctttctgctcctgttgccacctctgctaatgatggggaaaacctgcagagggctgtggttggagctgggctgaaggccggcaggggtgggtctctccatggcagtagcacacaggcaggcaggaagtggccctgtgcaaaagcgggaagtggcagttgtcaaacaggaaggggggggctgggctgtgggaggggcggggatgagcctggtagaaaggtgcgtggaggagggtccaccttggaaggtctgagcctctccctagtggttactggaaggaggggtgtctcaaggggagacacctttgcagcaccttgagatgccgagccagggccctcccactgtggaccaagcccattcagtggcctcgccctttttggggttggagatgctgcgtccagctgggatgcccttgcttttgggaaagatgctctagaaaccactactccatcctggaacccctctgctgccactgctgctgggatggaccctctgcttttttgcagccgtgggccagccctggatgtgactacaggacaggaagtgtcaggggaagagacaggagacaacagctggagaggctgggtggtggccgggcagtatgtggcagcaggaacggggagaccggggcaggtagaaactgctctgttcattgaggagagcttgtggatggcagggtgccacggctgcgaggaagaggagggaagcggacagtggcacttcctgcggcgttcccctctctctgaggagcccctgttgctgcccatcacctgcagactgtagacacaggtgggccccgccaaaacagggagggacactccacctccaggactgcaatggaggaccatgtggggagcccagaagccaggcaggagggcttagttgctgtgttgcagaccctgcatctgcctgggctgaggggacagtgggtcccattcacagtgtctctggtgatagctgtggccacaagcccagcccaggagaccctgtcaagcttctcactgggcccttggaaaggagctatatgccagaccttatgcaaaactcttgacctgtaccacctcagttaaacctcagatcttgctgtctctattttagaagtgaggaacctcttggccgggtgccgtgctcacgcctgtaatcccagcactttgggaggccgaggcaggaggatcataaggtcaggagatcgagaccatcctggctaacacagtgaaaccccgtctctactgaaaaatacaaaaaaattagccgggcatggtgatgggcgcctgcagtcccagctactcgggaggctgaggcaggagaagggcgtgaacctgggaggcggagcttgcagtgagccgagatcatgccactgcactccagcctgggcaacagagtaagactccatctcaaaaaaaaaaaaaaaaaa

SEQ ID NO: 2916 - DNA, 1435 bp, Homo sapiens
aattcggcacgaggttggccaggctggtcttgaactactgacctcaggtgatccacccgcctcagtctcccaaagtgctgggattacaggcgtgagccaacacgcctggctggctgaatattattttattgtgtagagtaatgtattcattcgttggttgataaggcatttgggttattttcaccttttggctgttgttccagataatgctgctatgagcatatttgtacaggtttttgtgtggaaatatgtttttgtttctcttcggtatataggaaaagaattacagaatcaactctgtgcttaaccatttgaagaactggttttcttttccaaaatggctgcaccatttacagccctgccagcaggttataaaagttccagcttctctgcatccttggcaacatttgttattatttttttattatagccactcaggtgggtctgaagtattttgtcgtgttttttatttgtgtttccttgttactgatatcgttcagcatatttccatgtgcttattgctcatatgcatatgttctttggagaactgtctgagattctttgctcatttttaactgggttatttctctttttattgttgaatttcaatggttctttatatattccagatacaagtccttatcagttacatgatttacaaaaattttctaccattccccattccttgagttgtcttttcactttcttgatggtgccctttgaagcacaacatttgtgtgtgtgtgtgtgtatttttagtagagatggggttttgccatgttggtcgggcgggtcttaaactcctgatctcaggtgatccacccaccttgccggtgaaccaccacagcacccggcccgtttttggtttttttgtttgtttgttttttgagccagagtattgctctgttgccctggctggggtgccgtagtgccatcttggttcacggcaacatctggctcccgggttcaagtgattcttctgcctcagcctcccgagtagctgggattacaggtacacaccaccacaccctgctaatttttatatttttggtagagacagagttttgccatgttcctcaggctggtctcaaactcctgaattcaagtgatccacccgcctcagcctcccaaagtgctgggattacaggcgtgagccaccactcccggccagaagcacaatttttaatttttatgatgttcagtttatatttgtttttccctttgttgcttgtatttttgtgtgtcttaatatgtcttctaagtctgttttaatggatggattctccccttcctgcctctcatttatctgttgaagaattttgcctatttgacctgtagagtttcctatggtctggatttttctaattatggttcccatggtacagttcaagcttctctctgtctctgtatttcctgcaaaaaaaaaaaaaaaaaa

SEQ ID NO: 2917 - DNA, 1472 bp, Homo sapiens
attgaacaaaagctggagytccaccscggttgcggccgytytagaactagkggatcccccgggctgcaggaattcggcmcsaggttttccagctccgtttattgtcttccataatgcttaacgtactgtttgtatatgttgtccttgcactatattttgatatgctctcatatattttattcatctctggctttctacgaaggcaagctcgcagcaacactgagaataattattctccgccatcaatcaagagtctccgtggttggctcctcatgggatggccttgattttaagcatgaaatgtaactcttgctctttggggccatttcattctttgttcctggggcctgcctgtgggctcgtcgggacactagagagcaggcattcccgtggccgcgggagagccgcgttcctggctggccattcccgggccctctagaagggagcggctgagagctctttagccctacttggggtttaaaagtgaaaaaggagcagctcttcctggtggaaattgcgagcagaggctgcgtgagttccgtaactcgcacacagcctccatttggagccagaatgagcacgtgagggaccccgggcagaggggccagtgctgacattatgctccatgcaacctcccatcctgttgtgggagatggtgcagaccaggggagggagtcagtgtgtgagggkatgakgctccagtcctttcctgggcaccaaagccaaatcccccctgagcacaaggatcttccctgggtgactgcagaagcaaggagacctggcccaccgtccctgctggcttcctactgcccagccgcgtctctgcctccctaccccaaagcctgcagctcctaagtgcactatttgggctgtcttgtttgcagcggatgtttgaaagacagaccctcttctctagtgctggccttgagtcctcagagagctgctgtttcctgggtttctagctccatggaggcagaaagagaccccagggtggcctttggaggaagatgagccccctgggttaaccgagcttctgcagtggtgctcctgggtcatcactgttgccactggtcagagccagagtgtgtctgcctgtgctctcctgaacacagtggagctatttccaagttcaggtgaaggggacatggaggttaagcaaggccagaaagacagagacgtcctcttcccctggtagcaggtatttagcagatgggaaaatattagcagatgggaaatcagcagatacactcagctcaagatgcaaatttaaaagccgccagcccctgtactaaatatttacactgaacatctctactccatcatccgtcttttatttttgtgagcccgtacaactgctcttattacaaagtcatgtaaaagttgaggaaagaaaatttcacccttggaaacaaattcatgatgaattaaatttcagcatgaaaatagaaaaaaaaaaaaaaaaaaaactcgag

SEQ ID NO: 2918 - DNA, 1447 bp, Homo sapiens
  misc_feature (859)..(859): n equals a,t,g, or c
  misc_feature (936)..(936): n equals a,t,g, or c
ggcacgagcaaaggtgatttgttggtaaagatggaggctttgttgagggttcttaatctggggtccctcccgaaagaacccaggacccccagtgaccacagatgtgatggggccggaggatttgggggagagggacaacagtttccattgtatctttgtcaccgccaccttcctggagactttcttctggaaaaggcttccctggctactggtccagatgggggtgagtcagggggctggactttgtccctggaatctctccttggccacttgcttccgtgattggtcggggggcactgaagggctgggcttctctctgtggggcctgtgctgcttgtggggttacacagagggaaaagcagggcagtgggggctgtgctgcggtgagtggcagttggcccagtcacgtgacaagatcctggagctgggcaggtcaccggcctttggagtggcgttcggcgcaccaggcacagcggggcggggggcccaataccttctgtcaagtgcatgacgtgggtctgtaccactgcaaaggactgggactgaccactgaagactggccagttgggctgagcacaaaatgatatttcaggagattggccaggccgaggtgggagagcagaggctcctggaagaagatgaggataggggctgggcacggtggttcatgcctgtaatcccagcactttgggaggccgaggtgggcggatcacttgaggtcaggagtttgagaccagcctgaccaacatggtgataccctgtctctactaaaaatacaaaaattagccgggcgtgttggcacacgtctgtaatcccagctacttgggaggccgaggcaggagaatcgcttgaacctganaggcggagcttgcagtgagccgagatcgcgccattgcactctagcctgggcaacactatcaaattgggaaaaataanaaagttgacaatgggctttggatgggtgtggtggaacaggaggttggagctggtgactccacatttccctccctagggtttgtctcaaacgtgacggcagaaaagaggtcataggtttgcctggtgccaaagcaggtgggagtaaaagacggaaatggctaggaatggccagcaaccgtgaaacagcttagaaattacaggcaatccagccaggtgcggtggcttacgcctgtaatcccagcactttgggaggccaaggcaggtggatcacctgaggtcaggagttcgagaccagcgtaaccaatatggtgaaaccctgtctctactaaaaatacaaaattagccgggcgtggtggcacacgcctgtaatcccatttacttgggagctgagcagagactcacttgaacccaggaggtggaggttgtggtgagccgagatcgtgccattgcactccagcctgggcaacgagagcgaaactctgtctcaaaaaaaaaaaaaaaaaaaaaaaaa

SEQ ID NO: 2919 - DNA, 3003 bp, Homo sapiens
  misc_feature (1814)..(1814): n equals a,t,g, or c
  misc_feature (1827)..(1827): n equals a,t,g, or c
ggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagayagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatsagtcacacattagtaccttaactctggaaatctagcctttgatgtttttaatttgggactcatatataaaaccagttttttttttktctcttttcgtagcatcttaataattatagcctacttctcttcacagtttcagctattttggaggatgactgtatgtattcctttttaaagtacctgttgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgyggtgatctggaagatgcaagcaaggctttagggtctgctggctttttcctagagtgtcaggagcatggtcagatctccatsattcttggagaaagctatgttggaggagatccttgcaattcctcctgttattaacccttccccttacccccaagartacatgttttgctactgcaagctactarttggcagaaaggttattgagtaagtaggtggcagtcttccttaaccctgtacatgggasagcattagtctttgcagctgaagagactmagcagtasagaakattcctctcattgtcttgatgagggactgacagcttgctagcgaaaatgttgcttgaccacaggawtgagacttccatgcaccctcatcttgccattattaaagctatccagctttgggtccagccttaagagaaggtagagtcatgactaggccagtgaatatamcagtgcatataaaagggccctagttaccagggagaaancagaagtagaccnctgaaagaggcaaaacctagtgaaaatagaattattgaacaaaatattgmscaaatacacttgaacaaaataataagggcacataagcagattgaattatamcaaattctttagagctagaaaaaaatgacattaagttttaatgtttagattatttaaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagactcagtctcaaaagaaaagaaaaaaaaaaaaaaaaaactcgag

SEQ ID NO: 2920 - DNA, 1524 bp, Homo sapiens
ggcacgagttggttttcccatttccttttttccttttcactgtcgaattataacagtttttatgtatctttacattgtaaagttattaatgttgtaatccttatttgcctgtttttatccttattcagtgtttatttttgcccattctctgacctttgacatttctgcattttgtattaaattgttatagttaggttccagttgtttgatgcaatccttttgtctttatataaacagttgagtttatcttatttagtctcactgtagatgtgtttaatcttttccatctgctttttatgcattcatattggcttttgttttgtttttaatctcttgataatggggctcaattttcagatatacttttaagatatgtttatgcctttatttctcaaattgcttcagaaacaaaatagtgtctattgtgatcttccttattctcataacacttaaggatgtgttggcatgttctgagatttttattcttgtttattacagttaaatgattatttttctgttttgtggcatatacttcaaaaacaatatttattttctgattttctaactttatttccacagatcctttgcattgagtatctgcttatctttcacaagacagcttcctcatttgtgagtcttcgtatgagtaatttcagtggtcagattctgtcttcatgataatttttttctcctcaagaaagtgcacatgagtgatacacgtcctgagttccttttctgtagacttcatgtgagaccatagcttctcatgctctagaattctgtcataaccattattgatgtataaatgacatacaataaactgcatgtgtttaaattatgtaatttaaaaagttggcataattatgtacctgtgaaattattactacaatcaagataatggacatacgtgtcacccttaaaagtctacttgtgccccttggtaatccctttacgctccttatctttaggcaaccaccagtctgctttctgtcactgtcaggaagtttacattttaaaacactttatataaatggagtcatacagaatgtacttttttgagggtctgggttgttccactcagcataattattttgagattaatctgtgttgttttgtatatcaatagcttattctttttattgctgagtcgtattccattgtacggatataacacaactcatgtgtctgttcacctggatacgtggaagtttgggctggtggaaatttgggctgttccaatactgagctgtaacaaagctgctacgaacatttatgtacaagccattcattgtacggacaaatgcttttgtttctcttgggcatatatctaggagtggagtgatttggtcatatggtaggtgtatgtttaactttgtaagaaattggcttcaaactatactacaaggctatagtaaccaaaacaacatggtactggtaccaaaacaggtatgtagaccaatggaacagaacaaaggcctcagaaataatgacatttatgcagccaacaaaaaaaaaaaaaaaaaa

SEQ ID NO: 2921 - DNA, 1842 bp, Homo sapiens
gattggcaggtgctgtgtttccccaggggtgaggtgccaggctggttttcacaccaagggagcatgcagttggtctgctggctcagctgtggcttccctaggggcaggatgctgactgggtcatatgccaaggaggcaggcacatggctggtcttctggataaggcttgacttctccactgggcaggacagcctgttccttggcagggcagagtgtcatgtggactcaagtgacaggatcacagctgtccccctgagcctaggttttgagtccctggggttggggcactgaagccactaggatggagaaaatggagtgattcctagacagcttgttcccatggattaggaagcagggaagcttggctagcaaatggtgtactactgtgtgtaagcatgatgcaaggatggtgaagcctcaaggatgaaaagatgcagtgactactgcccccaggaacagaacacactctagtagttgctctagtttcaagatggtgctgtgcagtagtagcttgggtcatgggatgggaggagccacagkatgggctcytactctagaataatgcagccatatgaactccaggcagcttccaaaaytggacttaggtcctgtgagaactgcaggattctccagcaacaaagactgctggtgtccacagatataatgggggcttctggggacttctttaccttttgttttcagggaaaagcccctcctaggcttgaatcccagcctgcattccaagctgatcctgactgaggagacagagttgcagaggcaggttgcagggttccattcccttctttatgtagccatcctgagtttctgtgatccacaagatttctgccattcccctgctgtacttcagtgctctcctttagacactccagtcaaaatgtagttgtttccttattgtttcagtctttttttaggcggggaggaggatgagtaatagacacctctagtcagccatcttgccgacatcaccgacaatgtcttttctcttaaaataatagaaatatggcttccatttactacacaagttttctgtttccctttataaagttttcagtgcacctggcctaaatgcctttttatttattgccctgcctagctccaagagctgtgctactggtcagtcttctggggaccacagttttccaaggaaagacagtgactctaagatattccatgcctcaggacaaagcaaatattctggtactatggatggaactgatgtttaaaagtttccaaaaacaaaaaaacacatttcagccgaaaagctgaattcctagtaatycaccctttagtaatccaaagcaattgtcatttycatctggtaaggaaagaataaagttttgtcttagggaaagtataatatttttcaaggggcagaggctctgagggttggataaacaaatgcccacacagcccatagctattaggggttgtgacatttttatgggctgctgcaagttggggagacgaggagagagcagagcacaattttatcatcttatcaccagaaaagagccccaggccgggagtggtggctcacacctgtactcagtaccttgggatgccaaggcrgtaggatyacttcagcccaggagttcaagactagcctgagcaacatcataaaatcttatctctacaaaaaataaataaagttagctgggcttggtggcatgtgcctgtggtcccggctacttgagaggctgaggtgggatgactgcttgagcccgggaggttgaggttgcagtgagctgagatcgcatcactgaactcaagcctgagagtcagaacatgaccctgtctcaaaaaggaaaaaaaaaaaaaaaa

SEQ ID NO: 2922 - DNA, 1895 bp, Homo sapiens
ggcacgagtgcaattgatgatctctgtgaacatggaaggtgtgtttgctttaagttagacatatcttatcgaattcttcatttctaggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgaggaaacagcagttaagggcttttggtttcttgtatttgcacaagccctgtaaaattgtttatgtaaataagaccttttatgtgtgacaattgaaatttgtccttaactctgaatgacctaaaaatagcaattccagtaaatactaaccatttttttctatttctattcagagcactaaaacaatgaggctattcaattaaagcaattctctactcatatttttatattcattctatctctttctccatccttctcaactttcaccaagttcacaagtatatagagtcttatcctcagtgtctaagccaatgcctgatactattacgtacgatgtgcattaactatgattccactaaaagatccattgtatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataactgaccccaaaaagtcagataaaagtaaaaaaacaaaagtataaatcatgtcatccctcccccatttgcaccgacatctctaaccacagacacacacacgcacaccatacgcaaagatagtcaccataattgaccatgtttttcaccttttagtcaatgttagaagcaaggggtaacttaagtcctggtgggaagaccatccattgagttctttgaaagtcaacatttttcagcccacgatagtgaaatgaaagtaaatataaatgaataacaattctaacaaaaagagttttttgattcaaatccattagtttgaacttttcgagcttattatccatttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtgtttttttcttattttagttttgaacctgtcttaaactcacagacttgtagaagaaatctctaattcagtatttattaggagttcacttttgccctattacagccttaattagtgacatcccagtgctgttacagcatagcagtgtcttaatatgtaatctaattgaaataacacatttgtaaaataattactagaaggtaaacttacgttaatgtcctgtgtggtttctacaaagtgtgtcattgtagacctcttggccactagatattttaagataaaaaaaaaaaaaaaaaa

SEQ ID NO: 2923 - DNA, 1641 bp, Homo sapiens
ataggttgaagggttgtgaccaccctatgttgagtacctctcttggcactatttttccaatagcaggtgcctactttgtctctatgtcagcttttttttttttttttttttgcaaaaagtattttaaaattagggtatgtacatttttgtttttagacataatgctgttgcwcacttaataggttacagtgtagtgtaaacatatcttttgtgtgcactgggaagaacaacttatgtgccttaaccttactgtgatatctgctttattgtggtggtctggaaccaaagttgcagtagctccaaggtatgcctatacagtgaaaaataatctctgattgtttacctcacaactctccttattcaaaagcagtatcaatttcctgtggtttgtattctttcttaacacattttaaacatatggtagtgttttcatacgatttattggtctttagcatggattttagaacataaggttttcgtgaatagtctaggggatataaagcaccagtgaataataacattccaggaatcaagtgtcccttctgcatgggatgacaagaatcattaatgctttctggggaaaataatggagtttcctatgggaaaaatgtgtagagagataatattgaaagagatgggaaatacagamcagagttcagggagattaaggcagctggaatatgcagaaccagtaataaagaggaaaaagagaatgccaggtgcagcggctcacacctgtaatccaagctactttgggaggcacaggccagcagattgtttgaggccaggagtttaagaccagcckgagcaacaaagtgagatgccatcactaccgccaaaaaaaaaaaaaaaattagttcggcaaggtggttcacacttctgtagtcccagctactcaagaaagaggtgggagaatcacttgtgcctaggaggttgagaagctgcagtgggatatgattgtgccactgcactccaacctgaggaacagagcaagaccctatatcaaaacaaaacaaaacaaaaaacagaagaatccttaaggctgagtatactggctcaaacctataatcccagtaccttggccctcccaaagtgctgggattgcaccgcaccaggccaagaatattttccattgtaaatgtataaattagtaaatgaagtttacctcaatcccatgtgtgttttagttggtgtgagctgtaccttgcatgcttaccctctggctacttgcaagaggcaggctggagacagtggtgtgctggtaaacgaccagctggggaaggggaggtggtttgatttatagcatttgcagatttccatgatgcaaatactcccgccacattggatttcaaaccatccaggtgatgccaagtagcttcctggaaatttaaccatctgctctcggtaactgctgccagcagctccagcacacaccactggttctagcccttcaaagcaagtttagctagcattcttctcatcacagacttttgagtttcacaagctaagtaaaagaatttttaaaaattagagaaagactttctgaaatcttttttcttcccttccttccttcctttttcccttccctttttccttccttcttttaccaaagacactaaaaaaaaaaaaaaaaaactcgag

SEQ ID NO: 2924 - DNA, 1807 bp, Homo sapiens
tcgacccacgcgtccgagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcytaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggaaaaaaaaa

SEQ ID NO: 2925 - DNA, 1467 bp, Homo sapiens
ggcacgagcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtccaggtatcccagcattatttgttgaaatgcctacacttctttatattcccttgactcctctaaccaaggcagttggacctttgctactaccactgccctgaaactgctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaagtgtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggcaaaaaaaaaaaaaaaaaaaaaa

SEQ ID NO: 2926 - DNA, 1293 bp, Homo sapiens
  misc_feature (1214)..(1214): n equals a,t,g, or c
ggcacgagcaggaaccccttcctgcccccgttgccgaggcagcactgccctctgctaggaacagctccgtgttggcctctctgtccccacacactgggcctgcagggcttctccgagactcttcagttcaggtatcaaccctkggctgtctcctggratgtggggggcgratgttctttccttgcctccccacgctcytcytgcggatccttcactccgggtgggtcggcctcttcctcctgatcagctccagagccccytctagttccctggcatggaaacacggcccgggtragctgtggtggccccgraggcctctccgctcctgcacaggccttgcttcctgcgggtgacgaggtcctggactctctcctgcccaggcttctgggtgctttccttagttcagcaccagtgctctgtgtgggcagcgtctcccccgaggatccgcagctccgggttacccgcaggcgtccatctccggtatggtgctgcccttcactgatcctggttgtatttctgtttcctgctttcctcatcgcctcctgtttcggttgattccttctttttgctggtgcccgtctcacagtagcttcctgagaacggggacctggcaggtacacttcagacctcctgtgtctgaaatagtgtcctggttctgacctgcacttgagtgtcggtgaggcctgggcagggttccgggtgggagctcagtttcgtcctgagtttctcaggccccaaccatggcctgtggtggcttcacgggctacaaggcaaaggacgcaaacgaagaggcttcacgtgacagggttgtatgctcagccagctctggaggctggagtctgagctggcagcactgacagggtcagctctcctcggaggctgctggggaggagcctcctgcctcttccgggctccgggggcctctggcacccccggtgtccccgggcttggagacgcagcactcccatgtctgccggttcccctggccgcctcctctgtgtcattgtctgttctcttcatatagggacaccagtcatcgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccnaagggcatttgcggcttctaggagccaagtaggaggaggctgggatccgtgtktcaggcgggactccaggcttgggcgg

SEQ ID NO: 2927 - DNA, 2068 bp, Homo sapiens
  misc_feature (57)..(57): n equals a,t,g, or c
  misc_feature (139)..(139): n equals a,t,g, or c
  misc_feature (2017)..(2017): n equals a,t,g, or c
  misc_feature (2029)..(2029): n equals a,t,g, or c
  misc_feature (2034)..(2034): n equals a,t,g, or c
ggtagagactctgttcagctagaagccttggatattatggctgatatgttgagcagngaaggaggacttcttgttaatttccatccttcaattctgacctgtctacttccccagttgaccagccctagacttgcagtgnaggaaaagaaccattatcgctcttggccatctggttatgaagctgtgggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaakttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtwccattaagagattaaaagcagctgacattgatcaggaagtcaaggaaagggctatttcctgtatgggacaaattrtyygcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactccaaggggggggccgggtaccaaattcnccctatagtgantcgtnttacaattcactgggccggtcgttttacaacgtc

SEQ ID NO: 2928 - DNA, 389 bp, Homo sapiens
ggcacgaggtaaatacagatgaagcttcactctctagcctgcacttacttcctactgtgtggcctaacacgccatagactggtactggtttgtggcatgggagttggggacccctgctttatttaatcacttataacttataatcacttagatgctctaagtcatctggggggtgagaaggttggaaaagaaaaagtacattagtgagtgagtaaagattatctgggattgtttcttagatgaggatctatttgatgttggtgttggtctactgtgaactaaatataactgcattggagcctaagcgcagatgtctgcgtcatggtttattactcctgtgttcgtttcaaggagctcctgtgatacctgctgtctccacctaaaaaaaa

SEQ ID NO: 2929 - DNA, 2027 bp, Homo sapiens
gggccattttatccttttctcctacttctgcccaagaracctgaattgctgccatagaggacagtgtttgtktggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgytcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcarcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcataaaaaaaaaaaa

SEQ ID NO: 2930 - DNA, 1345 bp, Homo sapiens
  misc_feature (1324)..(1324): n equals a,t,g, or c
  misc_feature (1326)..(1326): n equals a,t,g, or c
  misc_feature (1338)..(1338): n equals a,t,g, or c
  misc_feature (1344)..(1344): n equals a,t,g, or c
ctccagggatgtgatccggcatccttgagtttgctcacagtgcctgtgcaccattcgagaagcccagcccctytccctcaccaccaaaccagaaacccgggcccagctggctctccactctgcgccttcmtgtcggctaaggctgcagcctcctcytctgggcagatgggcagccagcytcccctcctgtcccggcccytcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccrgccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaaaaaaaaaaaaaaaaaaaaaaaaaaaaaaaaaaaaaaaaaaaaaaaaaaaaaaaaaaaaaaaaaaaaaaaaaaaaancnsggggggggggnccgttnc

SEQ ID NO: 2931 - DNA, 1093 bp, Homo sapiens
ggcacgagcggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaaaaaaaaaaaaaaaaaaaaaaaaaaaaaaaaaaaaaaaaaa

SEQ ID NO: 2932 - DNA, 1300 bp, Homo sapiens
  misc_feature (1086)..(1086): n equals a,t,g, or c
ggcggagcgagttacgagaattcccggccgctgcaaggggtgggagctgccctggggtcakgtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcangtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgartcgtaaaaaaaaaaaaaaaaaaaaaa

SEQ ID NO: 2933 - DNA, 798 bp, Homo sapiens
ggcacagcctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagmgaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggagkctgaggcaggagaatcgcttgaacccaggaggtggaggttgcagtgagcccaaatcgcgccactgcactccagcctgggcgacagagcgagactctgtcaaaaaaaaaaaa

SEQ ID NO: 2934 - DNA, 1050 bp, Homo sapiens
gaattcggcacgaggcaagattagcacaaagcatactaatgttttttgaaatacacccattgttaacattttgtaccatttgctttatcatttgcactctgtgtgttgggggtctgtgtgtgcagtatgcaataggtttttcttaaaccatgttagagtaagttgcatatatcaaagaaataccttttcccacaaataaacttaagtagttccccaaaataaggatattctataaaaccatagtatagctagcagttttattaaatttaaccttccatattccagttttatcagttgattccataatgtcctttgtggcactttgttactctcgtacatcatcccatccaggatcaggtatttcatttagccctcatgtgtcttcagtcacatttaatctggaacagttcctcagcttttgtctttttttttttttttgaccttgatgtttttgaggaatagtctttgttttaaaatagagtatttctcatattgtccttttttttttttttttttgagacagagcctcgcactgtcactcgggctggagtgcagtggcataatctcggctcactgtaagctcctcctcccaggttcaagctgtgctcctgtctccacctcccaagtagctgagattacagttgcccctgaccacatccagctaatatttctattttggtagaacaaggtttcaccatgttggccaggctgttcttgaattcttgacctcaagtgatctgcctgccttggcttctcaaggtgctgtgattataggtgtgagctactgtgcccagccctaagtaatattctaatgcgttattatgagagaaaatcattcttatagttaaaattaaatcaaaataattagtatgtcattttactaattgtacttttatgtgataaaaccacttttttttaaagttttggattgtgttaatttttcaattcaacatttataatgttaaatactgttatacattcaataaagtgttattatgccactaaaaaaaaaaaaaaaaaaaaaaaaaaaaaaaactcgagggggggccc

SEQ ID NO: 2935 - DNA, 1040 bp, Homo sapiens
aattcggcacgagtgaacagtragactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcattcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgattkgctttcgatgtttattctgtaataagatatttaaagatataatttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgcttaaaaaaaaaaaaaaaaaaactcgag

SEQ ID NO: 2936 - DNA, 2364 bp, Homo sapiens
  misc_feature (65)..(65): n equals a,t,g, or c
  misc_feature (89)..(89): n equals a,t,g, or c
  misc_feature (134)..(134): n equals a,t,g, or c
gcgagagctgcgtgttgaattcgccgccgagaactatctgagcggcggtggcccaggggacggangtggcgcggacaccgggactggangggaggaagtcgaggccctgcagctctcagctcgttggctggaantgctgcgcacctacttggagctggtgctttgcgtgctggtcagcatccggaacaacaggaaccttcagaagtttagtctttttggagacataagtgttctacaacagcaaggaagtttgtcaaatacatacctcagcaaggtggaccctgatggcaaaaaaattaaacaaattcagcaactgtttgaagaaatcctgagtaatagtaggcaactgaaatggctgtcctgtgggtttatgctggaaatagtaaccccaacatcactgtcatctctctctaatgctgttgccaacaccatggagcacctcagtttactggacaataatattcctggtaacagcactcttattactgcagttgaactggagcgatttgtgaatctgcactcacttgccttggatttttgtgactttacagctgagatggcaagagtcttaactgatagcaaccatgtgcctttgcaacgactgtctcttctggttcacaatgtttctgtaatgcacaagtctctggacaacatgccaaatgatgagcattggaaagccctgtcacgaaagagcaccagctttcgggtctatataatggcttttgatatcaagagtgaagatatgttaaagattctgaaacccagtataccactagagaggattcattttgatagctatatcacttgtgtttcaggggctattgttgatcttatatccaggcaatatgacaagttcctcactcattttattttaatgaatgatgtgattgacacatctggttttccagatcttagtgacaaccgaaatgaagatccgttggttttattagcatggaggtgcacaaagctctctcttctggcaattcatggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaaagaaaaaaaaaacatgcacctgtttcactgtgaatagtgaatgtaaaaaaaaa

SEQ ID NO: 2937 - DNA, 524 bp, Homo sapiens
  misc_feature (4)..(4): n equals a,t,g, or c
  misc_feature (37)..(37): n equals a,t,g, or c
aaantaaccctcactaaagggaacaaaagctggagcnccaccgcggtgkcrtmsgcwmtagwwccggtscacgwccctracttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttcctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttaaaaaaaaacaaaaaaaaaaaaa

SEQ ID NO: 2938 - DNA, 711 bp, Homo sapiens
gttctatcagttattaagagaggactatcgaagtccccaatgataattgtggatttgtctgttattttttgtagttgtatcagtttttatttaattgattttgaacctttcatgctaggtgcatagacctttaggattgtcatgtcctcttagttaactgaccccactatcattctgaaatgaacttccttgtattctttgttctgaaatgcattttgtctagtataaatatagctgctgcagcttttttgggctagtttaactatggtatatctttttcatccttttactttttatgtatttgtgtgtttatgtttaaagtgcatttatcataggcagcatatagttggttcttgcttttttatccaatttgacagtctctgccttttaattgatgtttgggtccatttacatttaatgttattatcagtatggctaggtttgagtctatcatcttgctatttgttttgtatttgttccatgtatgctttgttcccttttctccctttttctgccttcttttggattactgttttttttaatgattccattgttttttcttccttgatttattagctgtacctcattgttttattatcttagtagttgctttagagtttatagtataaatgtttaacttcctcctcctggctttcatgctagtgtcataaattttacttgtagattttataaaccttaaaaaaaaaaaaa

SEQ ID NO: 2939 - DNA, 1992 bp, Homo sapiens
gcatcctccgccaggacagagtctccaaaggctgctactccttcatccacctcagcttccagcagtttctcactgccctgttctacaccctggagaaggaggaggaagaggatagggacggccacrmctggkacattggggacgtacagaagytgstttccggagtagraagactcaggaaccccgacctgatccaagcaggctactactccttcggcctcgctaacgagaagagagccaaggagttggaggccacttttggctgccsgatgtcaccggacatcaaacaggaattgctgcgatgcgacataagttgtaagggtggacattcaacggtgacagacctgcaggarctgctcggctgtctgtacgagtctcaggaggaggagctggtgaaggaggtgatggctcakttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatmagacgccgaggttkagagatcccaggatgatcagcacawgcttcctttytggacggacctttgttccatatttgggatcaaataasgagatgggtctagcaatcaatgatagctttctcagtgcctccctartaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatagatgactttaatgatgaactcaataagctgctggaagaaatagaagaaaaaaacccacaactgattattgatactgagaaacatcatccctgggaagaaaggccttcttctcatgacttcatgatctgaatccccccgagtcattcattctccatgaagtcatcgattttccaggtgtgggtgaactgcctgtgactcctctcctcccccgcccctacccctcagggataatgagttcattgctgggctagatgttttagccatgattctgcctctgttttatacctgcacacgtccttatctttgttacatatgaaatatctgtatcacgggtatattgagagaaataaaggtgagagcattcacaaaaaaaaaaaaaaaaaaaaactcgag

SEQ ID NO: 2940 - DNA, 1161 bp, Homo sapiens
ggcacgagcggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttgggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaaaaaaaaaaaaaaaa

SEQ ID NO: 2941 - DNA, 1255 bp, Homo sapiens
ggcacgagctcattctgttttcttcatctttccctgaccagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaaagttggcaataccttaacaaatgcactctgagctggagggagcccaccatttgcacccacctgacccaccctcacccctgttcagatgaatttccaaaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttccactggtactcttgagtggcctgaagtgacccattctatgaattgttaattaaggtgccaaaaaaaattaataataaagcttggttttttgaaaaaaaaaaaaaaaaaaaaaaaaaaaaa

SEQ ID NO: 2942 - DNA, 2204 bp, Homo sapiens
ggcacgagattttttgtaagtcctacaagtacaaggtttttataagtacagcgttccaagtacctgggcactctggttggcttcagttacagctcacacaggctgagtcatctctgcctatgtatctatacaagccatttcacatccatagtaccaatacttttaaggtcaaaaacaagatgaatctgaatggtggcctttttgtcctccaccaatccctgtttctaccttcatcaaactactctgctgtttgcacttcctcacaacttcccttgctgcttatatttcttttttcccctcaggtgtctctccttcccttctaactggcagcagcccccttcacctcaggagcgggctttagatccgctctgccaggcagcttgctaacttctgtgtagctctctgaagcaggtagagaaatgttttgctaaatgcatgccgctcccactgcctttctagtcctaaccctcaatgttccttagttgtttgccttgtttcctacaatttcagctaaaactattgctcagtatgcagtattatgctacagtgtcccttgcaagtacttgttagtttgtgcagtgcttctgagatgtaattaaatgtttatgcaatgtttaaaataaactctagagggctaaagccattaatatgcccataggacacatctcgataaatgctggcgtatatggcattttcatgcaatagaaactgttagaatcaagggagaaatataagactaaaatatcagtaccctttcacatagcattcttgttttaacctatgacagatggatgtccagagccttttctttttcagagtccttggtttagcaacccttgttcgtttggtgttacttgttataatagcatttctttgcaccaaatgaaaataggttagtttgagtgttgacagaagtgtttatgttgaattttgtcacatatgacttttggatgagctgagtgtagagtttcttttgtctgtctgtttccattttttccattcgacatagttcttttcagtgctcggaattttttgaaagattgaatttcccaaatgtaagaaagaaaattttatccatatttccacaccagtgttactgtccagcatacattttgaaatgatttctagtctatagtgtaggcaaacatgaaaatagtactatgtagctgtttattaaggtatagatgtaatttaggtaattgaaatagatgattagttttgtgtgatggagtgcctgagcaggttctgacatttttataaaggtcaatgttttcacttgactgctttctagaggtgtgtgtttacctttctctcttgcaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacagaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaaaaaaaaaaaaaaaaaaaaaaaaaaaaaa

SEQ ID NO: 2943 - DNA, 1409 bp, Homo sapiens
ggcacgaggaaaaacttttggtactgtaattaatatattaaaaaagaaacattctgatttttttctggtctggctttttttctgtataattaaatgtaaacctaacaaggtttaattaaatttagtttacagctgttgcggcaaaaatgcaaaaagcaaattagagggaagaaaatatggtgtatgctttgtagacagatgggactgaatctctgttatcccaaaatgttcttttattattggtacattttatcagtaaatcaaggatagataccaaatattaatgtacacatgagccaattacttctaactagatttttctcttagtatttttttatctgtttcattattagtttatcagctccaaattagcatatccaaatgagttacccagcaatagataaattgcttttgattttgtgtcataattaatatttttatctagtcatttatctatcattttagaaactagccaagtctatgtgagtcataaaagaaaaatgaaaattatttactattagttaaattacagtggttgctttgagcaggttcagaggcttaagttcttcacaatctcttactacatgattgctgttttttcttccacagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgatcagaaaaaagaatgaatgttgcattgactagagaaagagcatttgttgattgtgggaaattagcctgtttgagaaaaatcaactttggggacgagtgatccaacactgcgaaggtaaaataaaaatgggtttaattcatgcatttcaagttcaaactgacttttatgggttaatgcttggggtgcttcaagcaggaacagctctgctgggggaagtaactgacatgataatattgggacctctgtaaaataaagaatagttgtctcatgtcgtatgtttttttaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaagaaaaaaaaaaaaaaaaaaaaa

SEQ ID NO: 2944 - DNA, 2389 bp, Homo sapiens
  misc_feature (314)..(314): n equals a,t,g, or c
tccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacganggcaattacagctgccgcactcacactgaaaaacgccccttcaagtggtctgagcccagtgagccgytggagcttgtcataaaagaaatgtaccctaagcccttyttcaagacatgggccagccctgtggtcamccctggtgcccgagtgaytttcaattgctccamcccccaccagcatatgagctttattctttacaaagrtggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagcmgtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaaaaaaaaaaaaa

SEQ ID NO: 2945 - DNA, 1338 bp, Homo sapiens
ggcacgagctgctgctcatttttctaaaaaatgttttattggaacacaattatgcccaattgtttacatatcatccttggctcttttcttctcataatatttactgtctgtatgtttataggaaaaggtttgctttagcttatgcatagacaattattttaatgtcactattaaaaacaataatttcttaatagtttaaatatcacatttacatagattaatttccaatcatgcatattgttttgtaccactactatttgttttgttctctcatctgtttattcctgtgtcaatactgctcttataatacctttgtgtacatttaaaaccttgaaaagcaaattacttttcattatttactttcaaattttttctaggaatttcccatgcatttattttttacataaagtttagaaaaaaaatttccactttaaaaaactgagatcctgattactgttatagtaagatgacatatcggtttaaataaaattggaaatattgtgatattaaaagtcttccaatccagaaacatgctatgtctttctatttattcatgttttagtttatgtccttttataactttttatagctcttttcatgtaggcctactaattttaagttaaatttaatctatgatattttgtagtttttactactttttaaaatgagattttccttttgcatacctatttctaacatgaaattgttagcattaaaatctagctagtcaacttggattcagccactttaccaaattgctttattattttaagcacgtttttagtagtcttttatattttttaggcaagccatcaaatggagatatttttggtttttgactatgggaatagttactgttcctgttttttaatcatgatgactttcatatttcatctttgttactatgtttttacttggatattgttaattatacttttccatgtttagactgtttcttctattcccatgtcactatgaattttaattaggaatgtcttctaaattttattcaatacgattttagcacatgttgatataatcacgtattttttgcttttttctctttaatttgtttatataataaattatattgagaaatttacttaatgctgaaccagtagccatggagtatactttacttagttaaaaatgtgacattctaaaatatgatgctgtattattttgaatataatttattaggaatttttatatctatcttgaaaaagaaactggctatagctttctgtgatagctttatcaagttttgatatcttggtctatgtcttgagagaatttaaataaaggataattgctctgaacaaaaaaaaaaaaaaaaaa

SEQ ID NO: 2946 - DNA, 1081 bp, Homo sapiens
ggcacgagcctaaacatacgttcacctgcatgctgcttctgttctggacctttgcgctggatgtagtcccaacagagtggcttgctgggaggagggagatacttttcagataaggcactagcacttcatcctaacaacttctccatactgaggcaacatttttaaatacacagagaatgcctaggattcaattgttgagaaaaattgatgtaagtctgtttgtctcaaagaaagctatcaggaactacagttttattaacctaaatgtacacctggtttgatgatgactatgtaaatgtatttttagctaattaatttattatttctgcccatcagccaacgagtggataaagaaaatgtgatatatatgcactatggaatactaagccataagaaggaatgaaataatggcatttgcagcaacctagatggagttggagaccattattctaagtgaagtaactcaagaatggaaaaaaaaatatttggaattgaggtatctaatagagaactgagttaaattattgccacttaaaaacacaaagtgatatagccactttgtgaattaatcagtcagcagtggctaggttatgcttagtggtttataaccaaatcttagtttataacaacaaatgtgtattgttaattcccactacaagtttataacgacattgctggatgctacactccatgtctctttgtgggacccaggctcatgggacttctgttatctgcattagagagagagaagacaacaaaatatgcactggttcttgaagctttggcccagaagtaaaatatgtcttttacctgttcacattgcattgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgatttcttgtttcagtttcatcatttcctactgtgttacctaaactttctgagccccagtttcttattactaaaataaaataatgataaagatgaaaaaaaaaaaaaaaaaaaa

SEQ ID NO: 2947 - DNA, 1877 bp, Homo sapiens
  misc_feature (854)..(854): n equals a,t,g, or c
  misc_feature (1422)..(1422): n equals a,t,g, or c
gaattcggcacgagctgaattccatgtttcattactgggtagaagttacagaacaaatggatttagcttattataaggagaagttttctaattgttagaatttacatatctgtggaatgaggctatttgtcaaactagagagttctttttcccttaaagatgtatagtaagagcagtgcgaacatctcacaagggatgttagatattcttctgtggatagatcttgcacatgatgacctcctgggctctcccagccctgtgattctgagatcacatgcccattcaggaatcctcactgtctagacccatccactaaaatgaatcatcatcttattcacatctaagccccattacmagtttattagtatcatccctttcagtggaaatgcgaaatattttattcagttatgctaatgtaattagctcataatgtcaaatgcttgagaagttgaggttgtagttctgctgggtatttgtttctcatgtcaaatatcataccatcagtgaaattgttcataaccaccaaaattaacaattagccccttcagcccctcttccacctttatcatatttatttgcttaacaaatttatcttttttttttttttactcattgattctgaatctccctctatttaaatgtatattctgtgacagcagtcctcaacctttgttgcaccaaggaccarttttgtggaagtcagtttttccacggacaggggcagaacaggggatggttttgggatgaaaccgttccacttcagatcagatcatcaggcattagattctcatgaggagcatacaacctcaattcctcrcatgtgcagttcataatarggttcgtcttcctatganaatctaatgccaccactgatctgacaggargcggagctcaggtggtamtgcaagcagtggggagtggctctgaatacagatgaagctttgctcattcaactgccactcacctactgctatgtagcccagttcctaacaggcttcagaatgggggatgggaaccctggttctatgagagcagaatccatgtatctttttgtaccactgaatcccaagcatttcgtgttggtacatttttctgtaagggaatccgtgtcttttgttggcttttaaaatggccacctaaaaaaatttaggaactactataagagtaatgttgtcaaaatcaaataccactgttgagattttgaatctgtgaaggataattgcattcttaatattttgtcttcccttccaaaatcatgctagttagtatttcttcatttattcaagatttcttttatgccaaatagtaaattttggtaattttctttatataggccataaacatgtattattaatttaatttcttggtattttttaatctactaatgggtctactaatgagctttctcaaaggaaggagagnagggaagaagaagggacattggaaaaggatatacagaatatttttatcagtctaggtaaaggttaacttgcctctggtaatctcatttttttaagttctttaagcatatagataattaagaaaataaattggctaggcactgtggctcatgcctgtaatcccatcactttgggaggctgaagtgggtggattgcctgaggtcaggatttcaagaccagcttgaccaatatggggaaaccccatctctactaaaaatacaaaagttagctgggcatggtggcatgcgcctgtagtcccagctattcaggaggctgagacaggagaattgcttgaacccggtagaattgcttgaacccgggaggcggaggttgcagtgagccgagatcatgccattgcactccagtctaggcaacagggcaaaactccatctccaaaaaaaaaaaaaaaaaactcga

SEQ ID NO: 2948 - DNA, 1352 bp, Homo sapiens
  misc_feature (1333)..(1333): n equals a,t,g, or c
  misc_feature (1341)..(1341): n equals a,t,g, or c
  misc_feature (1350)..(1350): n equals a,t,g, or c
atcgacccacgcgtccgagatcctgcctcaataaataaataaataaataaaaataaagtaaatggaattacacaatatgtgcttttggtgactggcttttttcactttgcatgttttcaaggttcatccatttgtttggtgttttaaatcttatgtggttgagtttggtttcatgtcagtgtttatttgccttttgttttcaaagataagaccacttaaattattagattatttgaattctccttaagttataagtctggtcctgctatatcagttatctaagtatttagaaatggtagactaggggacctaggtttcttaaacttttctctcttttacttaggtgtgcaatatgaataaaatatcagtagatttgtattttagaaaatgggggatacaagattggggactttattgacacatttaattctttcatgtgtaaaattacttatgtgaaaatgtgattttcttgttttttccccagactaaaaagtttttgttaattattatgagtatttctatagttggctgtttttacctggcaagaatgcttttctgctcagatgaagagataaaggcattaggcctgggatggacatttctgagtgaattaatgttggattggtattttttttatgagtggaagagacaaactatcttacatccattggttttaaaacattttttaatttcagtatatatatgtagagaaaagtacacatgtcataagcctatacagctcaatgaattttaagaaactgaacacacatgggtaactagcacccaaatcaggatatataaactgttccttgcattccaaaagccttcttttgtgcttctttccagtcattatcctttctccccaaaaaggagtcaacaccctgatgtctaacagtatagaatagtttagttcatccatggatgcagtgagccaagatcacgccactgcactccagcctgggtgacagagtgagactctgtctcaaaaaacaaacaaacaaacaaaaaacaaaccgaaaatattagtctgtaaagattgatcttgagcctaaacttttagatgttttctatcctttgaacaaatgcttctgtatcttaagcttggaaggacactgggaaactaaacacttttaaaaggcacttttctttcaatagcccacttataaagtttgctttatctaccagtacaggggaaaaaaagaataaagttggttttattccatttaaagtagttttggtatttctttgctccataccaaagtcttcctcccccaaaataaacaagtgaattagaaccaaaaaaaatcaaaaaaaaaaaaaaagggsggccgcnctaagggncccagcttncg

SEQ ID NO: 2949 - DNA, 773 bp, Homo sapiens
ccacgcgtccgggaaagtttatgtaatatatcttcagttacacacaaagaagcagagctgagatttgaactcagatgcatgaattcttaatataagttccatgattaagtttcagtagctatttgggaactcagtcatggggaaaccaccaactcatgaagcaatccattctgttgtaaaatggctactaattgttacaaaattgttacgtttgagtcagatctgtttccttttgtttcctttatttctgtttctaacttctgggacccgactgggaataaggttgatcttcttctgtaaaacagctgaattttttatattcaacatacattttataatcagaaaaataatatatactatttcttaaaaattagttttggggctgatgacaaacatatttataagtcacatatttatttctgaaggttttaagtgagtaaacctggactttaaaaaatgttgggccatgtgtggtggctcatgcctgtaatcctaacacttggggagggtgaggagggaggattgcattaatccaggagtttgagaccagcctgggcaacacagtgtgacaccttgtctctacaaaaaactaaataatcagctgggagtggtggtgcatgcctgtagcccccgctattaaggaagctgggatgggaggattgattgagcccgtgaggttgaggctacagtgagctgtgatcgtgccactgcactctagtctgagcgacacagagagaccctatttccaaaaaagagagaaaaaaaaaaaaaaa

SEQ ID NO: 2950 - DNA, 1667 bp, Homo sapiens
  misc_feature (1659)..(1659): n equals a,t,g, or c
  misc_feature (1664)..(1664): n equals a,t,g, or c
tgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaaaaaaaaaaaaaagggcggccgcnctagnggg

SEQ ID NO: 2951 - DNA, 1241 bp, Homo sapiens
tcgacccacgcgtccggctatatgtatcccatacatcatgtgatataccttaaatatacacaatcaaatgtacttttagaagagcaatagaaaaatgtatactaaacaaacttaattcaaccaacccctgtactatgccatgccataactacctcatagtgtggttgttagatcagataatcttctatagaatttttagtactgtccyccatgcatattaagtacccaataaatgtamctattatgtttcaagcaccttgtttcctaatgtacttagtgtttttcccccattttgagcggatatagtaaggactatctatgtcttttgcaccattgtatgtacttgtctcgtaggttgcttgatttttcagtagcttccatatttatacatttaatcatttttcttatgctttctgttttcatttaattcactggtatggctgctgttatctcttattttgaatctggtttttgcttatgataatatgtgaattattttatgcggaagtaatgtcttttataatgtttctgaactaaatggcattatttttgttttctcctggacttttatgataaaagtatttagaattcttgtttcataaattattatccatatagtgaatacatatttcctccatcatacatcagttgtcttttagcatgagagctttttatagagtaggtgaggatgtaattatttataaaataatactatatatctggttagagactctttgatcctttgcattgtatgacagtgtgttgtacattggttaaacagcagttagggacttctcaaaagactattgtgttctgctctgcctaagatgtttcatttagcttttggggaattcccattgccttttgtcagaccaaagaaaaggattaatatcagtctttaattttaaaaataattaaatcattttaatcaattaaaatgattgwggctcccacctgtaatccctaccctttgggaagctgaggtaggaggattgcttgagcccaggagttcaagaccagcctgggcagcaaagtgagaccctgtgtctaacacacacacacacacacacacacacacacacacaaattaactgggcgtggtacctgtggtcctacgtgctcaggaggctgaggcaggaggatggcttgagcccaggaggtcaaggctgcagtgagccgttattgcactactgcactccagcctgggtgacagaatgagaccctgtcttcaaaaaaaaaaa

SEQ ID NO: 2952 - DNA, 1054 bp, Homo sapiens
gaattcggcacgagccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccaaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcacccaaaaaaaaaaaaaaaaaaaaaaaaaaaaaaaaaaaaaaaaaaaaaa

SEQ ID NO: 2953 - DNA, 1560 bp, Homo sapiens
acccacgcgtccgagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcaattcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcttggcacaatgtaactaattcctgaacaaataatacttcatttgctgtcatatagaaaaaaattagaggtgatacttgtttaaagttaggactgcaagtcttaacctgtttttgttactagtycttgagaggttgggcaagtctgtacatcaggttctagctcactgtaatagtgattaggggatgatttgggagaatgacstaattgaattgaaaagcataataatagccaacatttcttaagtactttctatgtgctaggcactctgctaaatacattttattgtcttatttaatcttcacagtggaaactactattatcctgttttacagatgaagaaacttagggacagcgactaatttgccaaaagttatgcagattgaaaggagtggagccagaatgatatccccaataatttttatctcagagtttatactcttaatgatcatattggctccataaacagctttacacatgtataacctatgtggtgattagcacttgttctcaaatcaagtaatcagattgagatctttagtccctaacctgcatgccggcgaagaatggtctgtggaccggtgtggtggctcatgcctgtaaccctgagtctactaaaaatagaaaaattagccaggtgtggtggcatgtgcctgtaattctagctactcgggaggctgaggcaggagaatcgcttgaacccgggaggcagaggttgcagtgagacaagattacaccacagcactccaacctgggcaacagagcatgactccatcttaaaaaaaaaaaaaaagggcggccgc

SEQ ID NO: 2954 - DNA, 1390 bp, Homo sapiens
tcgacccacgcgtccgaaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtrraaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataatttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaaaaaaaaaaaaaaaaaaaaaaaaaaaaaaaaaaaaaaaaaaaaaaaaaaaaaagggcggccgc

SEQ ID NO: 2955 - DNA, 1472 bp, Homo sapiens
  misc_feature (55)..(55): n equals a,t,g, or c
  misc_feature (961)..(961): n equals a,t,g, or c
  misc_feature (973)..(973): n equals a,t,g, or c
  misc_feature (1464)..(1464): n equals a,t,g, or c
ggtcgacccacgcgtccgcctaaatctcccaaagtgctgggattacaggcgtgancactgcacccagtctggtttgactttcagtgacacttttacttcttttaagtgcataaagtaaaaaatactaagataaaggacgcaaattaattcctaattaacatatttatagtttggaaaaagtgctagaggtgcttgccagttcaatttaattccatgcccagaatgtggtttctgtttattgaaatgttcttagttttggtcatctgttactacttgctgttgtcttcacggggccctgactggccttggcataactaggctgctaggggaatagttcttagagagtcattttatgtattggatttwattctgatttgttttctctctgaaagctggttgttatttgtttttttkwkkkttttttcgatcttaggtggtggttgacacagcacagattgagaataaagaagcctatgccccccagatcagtttagaaggctctagaatcgtggttcaagtcccatccacatggtaacgtgcctcttactttcaccggagcctaagctctgactgacgtttgcacatctttgaaatgatggccttgttttgaacaatgcccatgctagctgacgcaacaagtcttgctgcatgtgcaggtttatgggcagcagtggtatgttagtggcatgtgtcatgattattggtctgtgatgaggaagccaagaagtctgaaaaatggtctcattgaccataatgtaactaaaatgttatatactcttggatcataatgagcagtattatctttgttactgagtctacagcatttaaacatagtatatcattttctckaagtcacccagtgtkcactaaagcccastaaagaacatagaattccttctcctctgttccaactacaatcctgatgatctygagctcatgttgtgacacacccagtgtcttnacaaatcttggnacagtcatttttagatattatatttgtamcacttataatagataaaagattattcttaatttatttttttttaaaaaaagctcctacaaatcagaagaaaatgggcaagggacatgaacagctaagtcagaaaagaagacatatgatcaacaaatagattwagraaatgtaatggccmagtgcggtgactcacacctgtaatcctagcactttgggaggccaaggtgggcagatcgcctgaggtcagaggtttgagaccagcctgcccaatgtggtgaaaccccatctctactaaagatacaaaaactatccaggcatggtggtgggtgcctgtaattccagctaatcaggaagctgaggcacaagaattgcttgaacccaggaggcggaggttgcagagagctgagattgcactattgcactccagcctgggcaatagagcaaaactatctcaaaaaaaaaaaaaaaaaaaaaaagggcggccgctcttngagaccca

SEQ ID NO: 2956 - DNA, 893 bp, Homo sapiens
  misc_feature (859)..(859): n equals a,t,g, or c
  misc_feature (875)..(875): n equals a,t,g, or c
  misc_feature (884)..(884): n equals a,t,g, or c
gaatagaagcaagggacataatgaaagagtcaaaaagggaaaagttttaaaacaatacttggcttactctgagcatagtttcccctttccttaattaacgcttgctcatatattactcagaaagtccaagtgtaggcttcagaggagaggagccatagatagctttcatcagattcttgatgaaacccacagtacaaatgttaagaaacacagctctgtggtatcatctgttgactgatctgctgctaatctatttaataggaagagttgtttctatatccttctacttttaccattaaagaaaaagtaatcaactagtcactgttcattttattttcaaatttatttttgcttaaatcattgcagaatcagaaaaaaatttttattatattgtttctgaaatgttaacatttaggtgaaatgcttaatcaggttgagtatcacttacctgaaatgcttgggaccagaaatatttgggattttttcagattttggaatatttgcatttatatgcttagtatttgaacatcccaaatctgaaaatccaaaatgttccagtgagcatttccctttggtgtaacatgaacactgaaaaagtttcagtttttgtagcatttctgattttttgtgttttacgtatgtatatgtatatctgtatcttgtttttttgtttggttgtttgagacagaatcttgctctgtcacccaggctggagtgcagtgagctgagatcaggtcactgcactctagcctgggcgacagagcaagatgcaagactctgtccccctccaaaaaaaaaaaaaaaaaaaaaaaaaaaaaaaaaaaaaaaaaaaaaaaaaaaaaaaaaaaagggcggccgntttaaaggatccaagnttacgtacncgtgcatgc

SEQ ID NO: 2957 - DNA, 1066 bp, Homo sapiens
cgcgtccgattttttgtattttttctagggacggttttcgccatgttgggcaggttggtcttgaactcttgaactcctgacctcaggtgatccacccgtctcagcctcccaaagtgctgggattacagcatgagccactggccgacttttgcttcctttacagattactttgcagattgacatccaggctatacccttgtttatgtgagcgaggctgtgttgtaggcactggcactatacttacacagaagttggcaacttctcattgccttgcacaaatgtggataatagtaataacaaactaatgttgaatgattagaattttaatcagttctttaaaagtagccattattttggcatgttaggtagggagagattcaaattatttatgttatcttcccaacttgagaatggcattattagatcaagccattagacttatagattgcggaagatttagatgtacttcttaattatgaaaattacatttaccttactcaaataaccccatatatacctaaaagttttaataaactaaagcatgaccacatgactcaatcagctgtccgtaataacctgtggtataggtaggacttagttgggcaaagggtgagatgtggccatcttcacgggctcataagagataaccaaggtcccttcaggtcggccagcctcatcatgcctcagctctttctaatcctgcttattagtaaggtggatgtttattcatttatttatttggttagttaaataacaggccgcaatttactgtgttacttaaattttacttaagtaaaatttaagaagaagaagaagatgatgactgtaaaaacaaaggtgtgaatatatttagctatacatgagataggatatcaaatacataaatagttcaatttgcagttgcacagtgccatttcacccaggttaaacaataggaagactcgatgcatacgtgtcatctgtaaatgctctcatgtgaaagaaattgtgaagtaaaataaagtatcttgagtagaaatttttctacattttctcaaaataaaaaaaaaaaaaaaaaaaaaaaaaa

SEQ ID NO: 2958 - DNA, 1436 bp, Homo sapiens
  misc_feature (449)..(449): n equals a,t,g, or c
tcgacccacgcgtccggcctcagccgaagccctcagccctgcggtccggggcaggagacaagcccagaggggctgggtgcagcagcctggcactgccatcggggcctccacctgacgccctcacaccagcccatgtctttcagctgtgcatgcgcaggctctgcctctgtcttcttcctgttctgtgtggcccagccccttcctggaaccaggcagccctggcaggagtgagggccagctgcagggaaagtgaagggggcaacacctgccaggctgtgggtctcacgaggctcgggggagttataagaggccccctctctcagggaactcctcccaggcttggggaggaggcatcctggacccagccacgccccacagatctgaccgaagcaggggttcttggtcttgcttggaacccagattcagccccctttgggaatctaatcaanggtgtggaccctttcccagagaaaatggtgtgttcactcctgagggtccatgggcccttgaagctgctcatggctcccctgctgcaggattcccctgggtgcccgtcaaactacagcttccctggggggcctccaccccatacttacccaccagcttcttaagagttcgagctcggacccttatagtagtaaacaggctccccagagcctggtggcctttctggggccacccggcagcctgcatgggacacccatggccttgtctcctccggccccagctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaagggc

SEQ ID NO: 2959 - DNA, 684 bp, Homo sapiens
ggtgctcggtcaagatcatgataaaccgctggaaagggagaagaagttaaggtagtactacagacagaatcttatactttggaaaaaaattcatgacaaagaaaccccaaagtattgcctgttccaccctgtctttgtggtgtgtgtgcctagcttccattattcatgaagtcaacctagaagggcagactggtaataacatgagttggtacattcttcctggcaatacataaagacctttaatgtcttaaattacttatcctagtaatattacttcctggaatctattctaacgartaatcagaaattttaacaggaatctatgcattaaaatgttcatggaaggaaaatgatcagcaatgaggaataattaaacgagacatatataaaaaaagcaacccacaattttttttcaagcatggagaaatgctcatgcgagaatactaagtaaacagcagagaaactcagacatacatggttgcctctgagtagtgaacttttatttccttcctaaatttttgtatttttaatctcttctataaatgaatgtgtattccttttacaatgaaaaataacatttttaaaaactaaaactaaagaaatgtattgtttccttttatgtataaatgtcccaagccaagatacctgaaatataacgaggaaaagattcttttgttcactctg

SEQ ID NO: 2960 - DNA, 1851 bp, Homo sapiens
  misc_feature (1171)..(1171): n equals a,t,g, or c
tcgacccacgcgtccgcatttgtccatatctataagactttacttctgggttctctattctgttctgtttatttatatgtctgtctttaggacagtactacacagttttgattcccctgttgtaggggaatcttgttttattgtgcttcactttattacgctttgcagataatgcattgtttacaaatggaaggtttgtggtaaccttgcatcaagcaagtctattggcaccatttttccaatagcatatgctcactttgtgttcttatgccataatttggtaattcttgcaatgttttcagtttttttcctcctcctcctccttttccttcsttttatcctcctcctcctccttcctccttcctcctccgtcctcctcctcttcctcttcctcttcctcctcctcttctccttctcctccttcttttccttcttcttctttctgggacagggtctcattcttctgcccaggttggagtataccggcacgatcatagcccgctgtagactcaaactcctgacctcaagcaatcctcccttcttggcctcccaaagtgctgggattagaggcatgagccactgcacctggccagtttttcattattcttatatatgttatgggaatgtgactagtgatctttgaagatactattgtaactgtttwgggggcaccataagccatacccatgtaagacttgaactgtgtattccagtgaaaggaagagctgcatgtctgtcactttaaattaaaagctagaaatgattaagtgctgtgaggaaagcatgtcaaaagctgggtgagttaggtcaaaagttaggcctcttgtaccaagtagttagccagcttgtgagtgtgaaggaaaatttcttgsaggaaactaaatgtgctccttcagtgaacagtcgaatgttaagaaagcgacacagggttattgctaatatggagaaagtttagtggtctgggtagatcaaaccagccacaattttcccttgagccaaagcctaatccagagcaaggccctaaatctcttcaattctttgaaggctgagaggaatgaggaaactgcagamsaaatgtktsaagctagcakargttgtttcatgatatttgaagaaagaagctaccattataatatgaaagtgcaaggtgaagcagcaagtgctgacgtanaagctgcagcaagttatccagaagctctagctaagatcattgagaaaggtggctacactaaacaacagattttcaatgtaaaccaaacagctttctaatggtgaagataccatccaggatgaggagtcaatgcctagcttcaaatcttcaaaggacaggatggctttcttgttaagggccactgctcatttaccattctgaaaatcctaggttccttaagaattatgctaattttactctgcttgtagtgtagaagtggaagagcaaagcttggatgacagcacatctgtttactgcatggcttactgaatagtttaaacccactgttgagccctactgctcagaaaaaaaagactcctttaaaaatattactgctctggctcacgcctgtaatcccagcactttgggargccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacctgggaagcggagctttcagtgagccgagattgcgccactgcggtccgcagtccggcctgggcgacagagcaagactccgtctcaaaaaaaaaaaaaaaaaaagggcggcc

SEQ ID NO: 2961 - DNA, 1693 bp, Homo sapiens
  misc_feature (997)..(997): n equals a,t,g, or c
ctcgtgccgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctrtttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatktcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttnttttaatcacttcatacaaggaaaacttcgacatttacatttctasatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaaaaaaaaaaaaaaaaaaaaaaaaaaaaaagggcggcc

SEQ ID NO: 2962 - DNA, 1298 bp, Homo sapiens
  misc_feature (319)..(319): n equals a,t,g, or c
gcctcatccctttttttcagtatgtgcaacgtatagagaaacagtttcttttgtatgcctactggataggcttaggaattttgtcttctgttgggcttggaacagggctgcacacctttctgctttatctggtaagaataatttattttaataagcaaaaatgatatttcctatctttttattggtgcttttatgtcagaagtaaaaattctaagatttgttttaattacctttgtgttttgtaagcattctgatcctccaatcagtgctttaagtttgacttagagttctgtttkgttttcctttagggttagtattnaaaaagcaaagagaaaaccccagttaagcaaataaggttgtttatttaaattagtttagcgtggaaggtttttcttttctttctagatttaattgcttaagcaattgttattttaataaatgaagtccatttaaatatgcaaaattccatgtgagaaatgtcttcccttacatcctctaacatcatttacatacttggatatttattttggtattcttgttgaatgtaattgatggagtattaacatgtagaactaaatgctttcttgagtcctttgaaccaaagtataaaaagtgccccttctgggctgggcgtggtggctcacgcctgtaatcccagcactttgggaggccaaggcgggcagatcatgaggtctggagatcgagaccatcctggctaacatggtgaaaccctgtctctactaaaaatacaaaaaattagccggacgtggtggcgggtgcctgtagtcccacatactcaggatgctgaggcaggagaatggcctgaacccgggaggcggagcttccagtgagtggagatggcgccactgcactccarcctgggcgacagagcaagactcygtctcaaaaaaaaaaaaaaaaaaaaagtgccccttctgaaaaatattcttttactagtggaaataagagagaatggccaggcgcagtggctcacacctgtaatcccagcactttgggaggccgaggcargcggatcacaaggycaggagatcgagaccatcctggctaacatggkgaaaccccgtctctactaaatatacaaaaaaaatcagccgarcttagtggcaggcgcctgtagtcccagctactcgggaggctgaggcaggagagtgatgtgaacctgggaggtggagcttgcagtgagccgagatcacgccactgcactccaacctgggcgacagagcaagactccgtctcaaaaaaaaaaaaaaaaaaaaaaaaaaaaaaaaaagggcggc

SEQ ID NO: 2963 - DNA, 504 bp, Homo sapiens
ggcacgagctcgtgccgaattcggcacgagatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactgaaaaaaaaaaaaaaaaaaaaaaa

SEQ ID NO: 2964 - DNA, 761 bp, Homo sapiens
ctgcaggaattcggcacgagtcccactacatgcagtggcccagggcagaggggctgatacatggcctttttcagggggtgctcctcgcggggtggacttgggagtgtgcagtgggacagggggctgcaggggtcctgccaccaccgagcaccaacttggccccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccgtggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtctcgtcaaaacaagtaaacggtggaactacgactaaaaaaaaaaaaaa

SEQ ID NO: 2965 - DNA, 1924 bp, Homo sapiens
ggcacgaggcaaacaaaaatctccagctgcccacgttgctttggtcatgacccttccttcagatcacttctgcctttatttttgctgtttaggggatgtgttatcacagaaacttggaatgcagagaaatgttatcacagaaacttggaatgcagaaaaatttttgctttttaggggaggtgttatcacagaaacttggaatacaaagacctccccccaccgcagccctgccccaccccacctaccccctgctggatttagcactgcacttccattttagcagtgatttccttcctttttgccctcgcctgccttccagtaacacataatttccttctatttccagagctgtcgatgatgaaatcgaggccaatcttgaagagttcgacatcagcgaggatgacattgatgatggattcaggagactgtttgcccagttggcaggagaggatgcggagatctctgcctttgagctgcagaccaccctgagaagggttctagcaaagcgccaagatatccagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctacgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcactctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaaaaaaaaaaaaaaaaaa

SEQ ID NO: 2966 - DNA, 1600 bp, Homo sapiens
  misc_feature (464)..(464): n equals a,t,g, or c
gggtggacttctcacatctcaggctacatttcccatgctcctgggcgtctttctaacagggttgttcctcccaatcttgatggcaatctttttgctgaagtgcaactcattttaaacttcaattaaattgcgtgaaactgactgttggccctgtggattatcggcacccttgtgttagagcccctgatgagaaatgtgtatttttattgcatatttaggccatttgaaaaatggttattacttacccatataatacaaagaataggtttcttctaagaaattcaaagcacactgcaaattaatcttaattgtttggcatttattcattccctgagtcattcatctattcggtaatgatttattgaatacctcctgtgccctggacactctgttaagttaaaaatagaaaagtmcatctctgccctcaacctgatagttgagatgaaatgatgtaatcgtgtatncattgagctagagtgcyctgtggtatgttctttggtatgcagtgtcagtaattattaataacagtaatgactaacatgtattgagtgcttactttatgccagatgttatgacagacccatttacttataactcagttgatccttcagacaatcaaccacatgagctgtcattacttgattatccccattttacacatggggaaacttaggcttagaaaggtatttcacccatcgtaactcagatgaaaagtggtagagttgggattcaaactcagacctttctggttatgaaacctctgttccagtccccaaattgctttgcttgaggccaaacatagagaattatttatagggtattctgttgcatttgtttttgtattttttctatgataataggtccagctgttaacaggtttttcattcagtataatattgccctgtaaaggaggttggctctgatgaatgccaaaaaacgtttctgttcaatgtataactcccactgtaggaggtaggtatagatgatactcttatggatggcccgtttgggtgtatgaatccataagctcatgacctcacatcagatggtttgaaataaaggtcaagcaataacaattcatatcttttcagtaaattttgaaattaatatggcagcagctgtttataagggactctgattttatttactaactaggatttacaagagaaataaaacttgattctcagccttcaaggaacttgtaatacagaaagttacttctagtgaaactgccaaactcagagctgaatgaaatggaaagtaagaaaagtgtatagaaagttaccagatggaggaccaggcatagtggctcaggccagtaatcccaacactttgggaggctgaggtgggtggatcacctgaggtcagtagttcgagaccagcctggccaacatggtgaaactccaactctactaaaaatacaaaaaccagccaggtgtggtggtgggcacctataatcccagctacttgggaagctgaggcaggagaaccgcgtggacccgggaggcagagattgcagtgagccgagatcgccccagtgcactccagcctgggcgacagagtgagactctgtctcaaaaaaaaaaaaaaaaaactcgag

SEQ ID NO: 2967 - DNA, 759 bp, Homo sapiens
ggcacgaggaggttgccccgactcctaatgccacatcaggctggctctctcccacagttagatctaatgggagagaaggtcaggttccaccaggggaggttctgagaccgaacttagtaagaagctattgtaaaggaaacagtaacaggagaaaactgtatggcaaatacatattttctcctgtatcaaagaaatttaaatcattttaagtcactctggacctgtttcttcatctgcaaaacagggaagttatagattagatgatccttatagttccctatatccttaaggttgtgtggttctatttttgaatttaaaagcagcttgcttttacagctcaaccccaggttctgagaggttcaaatagtatgttctggcaaaagggattcaggtaggtgaaattgctaaataaaagcatgctgatggtttgagtagttctccctgaccttgtgtgtgctttataagatcctttagtagtctctactctcgatgtacactggtggggacctcctcccagccagagagtggctccttgccagaccctcacactcatctgtgtcctatgttctggactcaggattgtgtgccagcttcagaggatgctctccatagccgtagaggtggacaggacccccacctgcagctccaataaaattgccgagacgatgtttgggtttgtgctggacattcctgagaggagccagaggtgagtcttgattttgttggggagagcagttatttaaaaaaaaaaaaaaaaaa

SEQ ID NO: 2968 - DNA, 776 bp, Homo sapiens
ggcacgagagaccattgagcctggcatatagtactcaataaatacttgttgaataaataaatgaatagcgactgtgatagggtaataataaaatagtaataatcactacctgtgttaagggcttactcttatgctagacactgttccaaatcctttccatgtttatgtttctccttttagtaggattgtgtttatttccattaaacatcaccaagaaaaacaaaaagaaatcctgtattaacatttgctgcatttctaaatgacattctggccaaaaactatagtttatcttgacgtagatgatttttgcaatcaagacaagttatcactcaaagaccactccaatttattgtccaatcctctggtaacaaatgtggtcagtaggagttcttatacctggcagatagacaagggcaatggttttcaaacttttatctcaagaactcattatacccataaaaactattgaagatcctgggctgggcgtggtggctcactcctgtaatcccagcactttgggaggctgaggcaggcggatcacttgaggtcaggagttcgagaccagcctggccaacatggtggaacctcgtctctactaaaaataaaaaattagttgggcatggtggcacatgcctgtaattccagctactcgggaggctgaggcaggagaatcgcttgaacctgggaggcagaggttgcaggagccgagatcgtgccactgcactccagcctgggcaacagagcaagaccctgtctcaaaaaaaaaaaaaaaaaaa

SEQ ID NO: 2969 - DNA, 1573 bp, Homo sapiens
ggcacgagagacaggggatccccctgatactttaggatggaagtaatagtcatggggatttattctgcaaggggaatgagatggtaagcctttggggttgaattatctaaaaacaagggagagggagtgtgctgctgtctctagaaagatgaaatgtgtgcttctcctgtttgttaaagctcttttgggggtcccagtgaaagcaagcataggtgaacgatcaggagcacatcagtgaggaacgcatgttcagaagcccccatgatgctccttttcttcctcttaagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggaatgtgatgagcagccaggaagttgtagatttcattcaatcaaagatcagccagcgtgatgaaaatggggagcttcggttattgtcatccattgtggaagaggtgagtaccagggtggagaagagagggtgtctggtctgcacagccagggttcactcttttaatctgagctaagtcggcaatctgggagcattatcagtaattgctgacagacgctaaaccccgactccaaagttccaccttctgtcatttccctgacttagccttatgccttatggactagcaggtgggccgttgtgtgatacctcttgcccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctctagccttagcagtgggtatgaggtgtgcagggggagctgggtggcttcactccgcccattccaaagagggctctccctccacactgcagccgggagcctctgctgtcctccccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtaaaaaaaaaaaaaaaaa

SEQ ID NO: 2970 - DNA, 1440 bp, Homo sapiens
tggacaagagccgggaacagacgcctccttacacaggacatcccaggactaatcaatgtggggaaaggtgctcacgtcattgcattagcatcacaacttcaagaaaatgctcgttaaaaccagagtgacttgcaccagcacccgccccagaacggccgaatgcccatcagtgctggcaagtctgaagcagtctggcctcacaccctgcgtgtaggagtatgcagctctttggcaatctcttctgttttgctttgtttgtttttaaccatcgaactgcagaagataatattttctgaggctcagcctgtacataccctctgacccagcagcctgcagccctcgttctacccaggagagctgagtgcatctgtccacaccgacagacgtgtccatagccactttggtcataatctcccaaaacaagaatcagcccagtgtccatctacaggggcatggatcagtggaggcctaatcgtacagggccccaaacagctgtgaaaacagacatagtactgctacctggaagaagcttacattttgttgagtgaaagaagccagacactaaaaagggcatactggccgggcacagtggctcacgcctgtaatcccagcactttgggaggccgaggcgggcggatcacgargtcaggagattgagaccatcctggctaacatggtgaaacaccgtctctactaaaaatacaaaaaattagccgggtgtggtggtgggcgcctgtagtcccagctactcgggaggctgaggcgggagaatggcatgaacccaggaggcggagcttgcagtgagccgagaccgcgccacggcactccagcctgggcgacagagcgggactccgtctaaaaaaaaaaaggagggcctactgtgtgcctccagttctgtgagggtcagaagctgatccacagtaatggctgccaacagtgcttaccttgagagagggaatagcaggaaagccacacgacgagccttctaggatactggggatattctctctatagatctggatgtgtatatgatgtgtacattcaccaaggtgtacacatgagatatgtacacttctctgtattccattacaccttggtttttgaaaagacagaaacagcatgctcagcttattaagaacctgaatattttcagacaaaaagtatgtctagtgttagtccacttttttttttttttagttttagactcacagagccytcttagggtcatatttagttgtatatcatctgacaaaagagggaatggctcacccagctgctacagtcagtcttgtagcctttgtaagatawwgaawgataaatcatacaataaattaaaactttcggctgggcacagtggctcacgcccataatccccagcactttgggaggccgaggcggaggatcacttgagcccaggagttcagatgagcctggccaaca

SEQ ID NO: 2971 - DNA, 1544 bp, Homo sapiens
  misc_feature (467)..(467): n equals a,t,g, or c
  misc_feature (471)..(471): n equals a,t,g, or c
ggcacgagcttgaataatattttgagtaagaaaaacagatgcatctgacagttctttttccacccactatctggggatgtctttttctggggctagtccatcttgtcctggataactaccctatcttgagaacccagtcttagtttcatgaaacatctttaatgaaaacagccttttgggatggtgctgctgcaaactgtggtctggctctcctcgcatgtgctctggctgccgcagaacagagctcaggccgctagggggcacctccacgtgccgcttttagcagtaccagccacctcaaagctttgccacagactgaatagctccttccgggggcctggatggcacccaggggatctgccgttgcttttttaatttatttttttacatttagctcattaatatctgttagatatttttatgtctgcattgaaatatgtaactttatttttcccccaaaggataantgtnccaacattatcagttagcttgtcttttccccaccatcttaaaatacgactcttatttttaaaattgcattttataaacatgtatgtttcagtaatttatattctgccccactgatctatattcccatcttagaattatacttttattttatttttaaaatttatttagagacaaggtcttggtatgtcactcaggctggaatgcagtggtgcaatgataattcactgcaaccttgaattcctgggctcaagcaatcctcccacctcagccttccaagtagctgggactacaggtgtgtgccactatgcctggctaatttttttatttttatttttttgtggagacgatgttttgctatgttgcccaggctggtctcaaactcctgggctcgagggatcttcctgtcttggctgcccaaagtgttgggattataggcatgagccacctcacccagccttagtattatactattttagttaacaaagctttacaatgaattttgatacctagaaagactgcacccaggtgaaataaacagccttgtttctcacacaaagcctgtttggtggtctcttcacatggacacgtgagacagatttcgctagggaagcaaataaccatggaggtgggcaagaaatatccatgattgtagagctttcaatcagccttttattcttgtaacaaatgaaaaacaaaggattatcagacatctgcggaaaacctctaacatagaagaaggagataaaatgaacaaacaataaaaagcaacttaaaaatggacaccatataaagaaaggaaaacagtttaaaaaaaaaaaaaacccaaaaccctattcttaagctacagagaaagcctggccaacatggtgaaaccctatctctactaaaaatacgaagtattttagccaggcatggtggcacatacctgtagtcccagctgctcaggaggctgaggcaggagaatcacctgcacccgggaggctgaggctgcagtgttctgagatcacaccacagcactccagcctgggtgacagagtgagaccttgtctcaaaaaaaaaaaaaaaaaaaaaaa

SEQ ID NO: 2972 - DNA, 1335 bp, Homo sapiens
tcgacccacgcgtccgaaagaaagaaagaaagaaatcatagacaacgggaataaaaactgcaagatacctaggaatgaatccaacaaatgcactttcttcacagatcaaagcataaactctaattgaagactataaaaggcacatgcagtgttcatggcaccatagccatggatgaaaagactcatcattgtggagattggcagttctcaaattaatctgtggatttattaatacacttttgattatattcccaggagagatttttataaaatgcagaccagccaaggcaatattgaagaggcgcagacggcattaagaagctgcaattgcagggcagccaggccaagaggcaccagggccctcagcgcacagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgtaaaagcctttcagagaaaaatcaagaggaaatcttcctaacagtgaggaacaaaaagacagattgaacaagagattgagggtaaagacatcaataggtttgactctacagacttcttcatgaccacaagaaaaatgtcacggttgtaatgtaagtggcagaataagaaaagatatttgcagtatctacgagttacagaatatatataaaaatatgtgcaactgtctgtcgtgaaaaaaaacggcaaacaccacacatcgataaggatttggggacattggcttgtgtgtgtcctgccgagagtgtagatggtcacccatttggggaatgaaatggccttccctggggagatcagagtcatgcaggatacatgactggcagttccgttctaggcgcttccttctccacccgcaaggacacgtgaagttgtcgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggcgcaggggcagacgatgcttttactgtgtctaaaattatgcttctctatgaaaaaaaaaaaaaaaaaactcgag

SEQ ID NO: 2973 - DNA, 1628 bp, Homo sapiens
ggcacgagttacataccactcctttccctgtgtctgtgttttttgcttatgctcatctgtttggattttttttcctcctgacagaattgtacttaggcctcaaagcctaattcaaaaggtcacttccttccctaagcctaacctacctcccaataatatttaatggtaatttcctctgtgattacccctatagaataacgtagcagttatgttatttaagggtaacataaagggtatttaacccattatgttatgctgtttgtgttgtatatgtctctgctctcaaaggctgtgagctctatgaggacaggaactatcttaatcaattgtgtattcctagcaccccatacaagtgcctggaatatagctacaatcaataaatgtttgtaaattgaattgaattgaagggacattacaacattgtagtataaatcactttgtagcctgagattgatcactactgcaaatactaaaagtggaagaacatatacctttactattcagtagaatagttttatggttaaatcaatagcatcgtgtaacatgtgatgatgtgcgtttatgcatttatccaaatatttgtaagtttaatactgaccacgatgtatatggctattgaagaaaaccacacataatatgtgtgtgaggtttgaaactagctctgttgcctaaggctgtctttgtgccttgccagaatgtggaccgtggcatgatcggcctgaatatttagccatcctcatgatagcatgtggaataactggtttacarttcatycgtttcatacatactctgcctagcatgttaaaattaactggaaactgaagaattggagccaaagttagaaaatgaagagagttcaacttgaaaccatcaggaaacaggctgattacatgaaggtctttttgtttgtttgtttttaacataataaatagagatggggtttcaccatgttgcccaggtggttcaaacttgtgggctcaagcaatctcctgcctcagcctcccgaagtgctgggattacaggcstgagccaccatgcccatcctatattttttttcaggcaatatccttttgtgctcaagaaattaagacacacaccccaccacaaactacatttgaagactctgccaaaaaaatgccatgttttttctcattttctttcatcagtaattaatgataccaagaacacttatatgcatggtttatagcagttggctatggtcaaaaaaagttgggcttcccctctgagacatttgcagatatatgtcctaggtataccatcagtggcaaataatgcttatcttaagatctaatctcacagggcatgctggctcacgcctgtgatcccagcactttgggaggccaaggcaggaggatggcttgaggccaggagtttgagaccaacctgggcaacatggcaggaccctgtctctacaaaaaataaaaaaagttagccaggcatggtggcttacacttgtggtcccagtgcgcaggaggctgaggcagaaggatcacttgagcactagaggtggaggttgcagtgagctgagattggagtgccagtggactccagcctgggtgacagagcaagactctgtctcagaaaacaaaaaaaaaaaaaaaaaaaaa

SEQ ID NO: 2974 - DNA, 1957 bp, Homo sapiens
gaattcggcacgagcaaatgttggtttgtatatatattttttaaaaggcactagacttagaaatgccaaagtaattaattttctttattttcagaaacaatttagtgttcatggtacgaagtgtttctaaattgaaacactttcagattaatggatttaagataactggttgctcttttctataagtagtaataatgagatatggcttcagctacatatcagataccagatctcacttcctgttcctttatttcattcatccattcattcagcaaatatttgctgagcactaaaatgctccagacacagtgcatgaaccctgaagatataggcaaattgcataacccaagcaaagggccagagatgagcaacagcatggtacataccccaaactaagaacttcactatgggctagggatatataatttagaagaaagaaggttaggttggggtaggaggaagcataataaattatgaatttagagatgtaatcaaattatgaagggtcatgaaagccttgtacaagattttgagtttgatctccatagagtcatataattagattaattttagaaagctcatagtgtctgcagtgtggagagtagattagaaggaagcaggcctggaagcagggagatcatttgggagacttttccaggacagagaaaatggtggtctaaactgggatggttgcaagggggatgaaaagastagatatytaagagaaaatttaagaatacttatttagttcagacgttcctgaaagaatgagcctaaccatattcttgatcatctaaggaaggtctattccttctcaaggacagctaagtaaactaataattgattctaagtgatgtaattgaacagttcaaagcagttattcgtcattagaaattattgatactggtcagataatacctactgagagctagtcccattaattttcatcataattataatcatagcatttaagccatattatttctcagcatttcctatgttccagttttatagcactgaatattttaaatggtttatattacttaatactcacagtagctttacaggtagatattattgttatttccattttacaggtggagaccaaggcttagagaagttaagtactttgcctaaagttacacaggttgtaaatggtaaagctattattggaacctagtgactttttagttactggcccagctgggattagaacccagctctatcctgtattattatttccaagacttttatttttgttggggttaattgctaatattctgtacaacttcgttttagcccagtcttgcatataatcatattttctgcataaataagataagctagagtttgagtgagcacatagtgaagaatattgactatttgtttttttctttccaattagttagggtaaagcaagtgtaaagggaagtggatggtaaggcattttgaggaggcaatcaaatatgtttttttctaattatatatttccaagccaataatttctttgaagaagaatgttttaagcgtgtttctttaccatgttaggccagtaggtacagagaaaataatattagctctttatgtcagcataggtaacaaagccttaaaaaattcacagctgaatgcaacagtgaaggccgttgacaagagaggttgcattacttcaaccagggctactgcagtgaaccaaaaaaagaactgagttctaggcttccatctccaggctacatcttaactgactaagagggcagtttagctgtccaggaagaactcgattgctaactctcactgataattttgcaacagtgacaataaagaatgaattttaaaaagaaaaacttgtctccctgaactattgaactccagaaaaagtagtacttacagtctttgctttaagagaaaccagttaaaaaaaaaaaaaaaaaactcgaggggggcccgtacccaatcgcct

SEQ ID NO: 2975 - DNA, 636 bp, Homo sapiens
  misc_feature (31)..(31): n equals a,t,g, or c
  misc_feature (35)..(35): n equals a,t,g, or c
  misc_feature (40)..(40): n equals a,t,g, or c
  misc_feature (630)..(630): n equals a,t,g, or c
agaacacaatattgttttctgtctagtgtgngggnagtgnttttttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttraccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccagatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaaaaaaaaaaaaaaaaggggggccgntctaaa

SEQ ID NO: 2976 - DNA, 1320 bp, Homo sapiens
  misc_feature (831)..(831): n equals a,t,g, or c
ctaacagcgagaacgctttggtgaggacggagccctcacgacctcagcagtgttgcgttggggatcaggtttccgatggtgaacttggggacacgtccacaccacagcacgtgcctattgtgtttctcggtggctggtgtgtttgaggatggcgcgtgcatgcgttttccagctttctttgtggaggaagttacctgtgggtattaacctgtccccagccatcctctcactgagcttgggttgcctgggcctgggtttcctgttgttgctggaacgaatgaccacagacagtggcattagacagcgcaggcagacatgacctcctgggcttctgcgggtgccaacactgccgctccttctggaggctcagggaggctcttgagggcattgggacatcgtsctgccggccgccgggcagagccgktttgtttattttttragacttccgggaacatagttataaataactttaatttgccttggcctgcccactgcagtacagtcacgtgtcacataacattctgtctaccgtggaccacatatacgaccacgcggtcacataagctgacaatactgtatttttactccactttctctatttagatacacagttgccattgtgtcccagcagccttcagtamtcagtacagccatgtgctgtgcaggtgtytagctcaggggcatgrggccmtggcccagcccagtgtgcagtgggtggcaccttctggatttgtgtcagtcamtgtggagttcgcacaatgacagaytcacctgggaggccttccgtgsgsttctgtttctttctctmatttgattgtggctagaaacagnstgggaaccaggagtgcagyttctcggagtamgtggctgccccacggggtgggatgtgcattttcagtcacatttggggagagcacgcgtgttcttaagtttttagtgggttctagtaagaatggatgttgatttttagaattctctcctgtttattttttaacattttgtggtgggaatttgtgaaagaatacgaagtcaagagcatggtacggtgaggacccagcaccatctccaacctccccggggtccacgtggggtctgcgtgtggccgcctgtccctcagcacgatgtctgggtgtaaatctgagacatcacagcatgcaggctgcagacgtaggcatctctacaaaagaaggatgcgtttacaggagaatcgcttgaacctgggaggcagaggttgcagtgaatcgagatcatggcactgccctccagcctgggcgacaaagcycagactccgtctcaaaaaaaaaaaaaaaaaaactcgag

SEQ ID NO: 2977 - DNA, 1521 bp, Homo sapiens
ggcacgagaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaaaaaaaaaaaaaaaa

SEQ ID NO: 2978 - DNA, 1103 bp, Homo sapiens
ggcacgagatcacttgtcaggatacaaaacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtaaaaaaaaaaaaaaaaaa

SEQ ID NO: 2979 - DNA, 968 bp, Homo sapiens
  misc_feature (261)..(261): n equals a,t,g, or c
  misc_feature (847)..(847): n equals a,t,g, or c
tttgtcccttggctttgctgcaagtctttttggaaagagacaagcatggcccagcccagaagttctagaagtccttggcctcatcttgcctcaagggcattgcttagagatttccagaatgtcattacttaatggaaaatctatagggtctgcttccttttgggacagcttggctctgcaccctggccgcctgtgtccttgtggctgggctgctcctgcccctgcctgccatcacttacctggcgtgtgcttggtgcgcanatcagctatatgtttctggagctgctttctaggagaaatctaatcatagaaaccaaactgaatggcattccttggcctcactctttgtaccctccatcttgggatccaggcttccacagtgcctttaggcctcccctccccttgaccccatcacacttgtccccattggtcactttggacttgctggtcctgctgcatggaagccctctccagcctactccacatgtgagtggggtttaaaccccactgacttgtttccttgtctgtgatgctgtccttctaccaatacttgtgtccagtcacttggtgtgtcctgtaatctatctgtgtctggaccaagactggtacactggacccaaggttcccagcaagctgatatgtggcttgtgtcatttgtccctgtgtcttctcctatctcactggcctcctatctccacagcctagtccatggagttgctttatgtagcaaattctccgtttggagcttttaaaataggattatttgccagaactgcatttacaaaaaaagtttgtgtaatcctggtttaaataaattacacaaagtaattcactggcagctagggtncctagtgtgtgctaggcataaagctgcttctgaacccactaaaagttcatcccagaatgatatctccactgagttcttaggtttattactagagatgaaaaaaaaaaaaaaaaaactcgag

SEQ ID NO: 2980 - DNA, 1544 bp, Homo sapiens
  misc_feature (808)..(808): n equals a,t,g, or c
gaattcggcacgaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaacgcttagaactgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgtygtgaacccgctttgtgaacaaggacaaagcatgtcatctgtctctgagccycagtctccctgttagtcagttacagagagagcgctccaagtttccttccaaagctgtgcactggctcgtttytccatcagctttggttttccagttggtctccagctcatctttgcctcacaagagcgtgccctgctagttgctggtgctgggagtgggtgggaaggtgattgggcgccagccccttccttcccaggcttcacacacacaccccaggaasccccgcggtgcgtcggactntctgtctagacatcatctgatttttatttgcaaatgcaggttgccaggtgacaggaccttttatgyttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtragtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaaaactcga

SEQ ID NO: 2981 - DNA, 677 bp, Homo sapiens
cggcacgagccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtgcctgggggcgccgtctacctggtgtacgaccaggagctgctggggcccagcgacaagagccaggcagccctacagaaggctggggaggtggtcccccccgccatgttaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgtaaaaaaaaaaa

SEQ ID NO: 2982 - DNA, 1678 bp, Homo sapiens
ggcacgagcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaaaaaaaaaaaaaaaaa

SEQ ID NO: 2983 - DNA, 1679 bp, Homo sapiens
  misc_feature (20)..(20): n equals a,t,g, or c
  misc_feature (1517)..(1517): n equals a,t,g, or c
  misc_feature (1530)..(1530): n equals a,t,g, or c
aatccccctcactaattggnacaaaagccggagctccaccgcggtggcggccgctctagaactagtggatcccccggtctgcaggaattcggcacgagcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtatyggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtngtttggttctcgncttggctcagtggtttggtgttccctcgtctgcaytggaaactacataaaactttggctttttactttggtaatgggcgtataattcargccctgtttaaatatacttgcctttcaaattcttcaaggtaaccatgggaagtattcttg

SEQ ID NO: 2984 - DNA, 1425 bp, Homo sapiens
gctaaatttctccattttttcctctttccttttttttcttaccacacattaatgtgagaagattttacagactgccttttacccctatgtctgggtcactgatgacctctgtatggctaaatccagtggacataattcactggtagcttttgttgttgttgttgttgttttgttttttgtttgttttgagactatgtctccaaaacagtaacamcaaaataacaaaatggtactcattatcgtgtctactttgccatattctctcctcctcctgtctccacagcatccacttaagcccgaaccctctagaagccctcatccttgactcttcccccatytcactctatgtagctcattagtcactaaattctgtttgtacaattcctaaacttctattaaatttgtctgcttccctccagagtcctgctaattccctgaatcaggccactgccatctcatgcctgcgttgcactgaggacctccagtctggaagctcattttccatatctttacaaagcagatctatcactctgaactgttgtctcgacccgagttttgataggtattgtgctgggatctgaccattcaaaatacaatcactggaatctgaagaagtattctgtgggagtgaatggaaatatatatgacttttaaatgggcaaaggtaatgtttttctgtaagaattaaatacctgcagttgtattatttgaaggtgcattttcaggggcgagctgcaaaacatctgtcaggtcccaacatttgtctactggtgtttttttaaatgtggattgccaaaatctttattcatgatggacattatgtaggagtggttaatacttacatagcacttacctgtgtcaggcacactgatcaaaataaccgacgaagtattattcaacataaagaaaaatctaacttggatgtgaatgatcagagaacttaagttttaatttttaaacctttcagaaattgttaatatagatgtttataacttccaccttttaaattatttcacttattgaacagatattagtgaacttctaggtgctgaggaaacaacaaagagcaaagcaaagtccctgtcccccaggagttcgcgttttaacggggaagaaaaataagcaagtgaaatggacgactgtgagaagacggagcagggagatgttactattgcttgtagggtggtcacagaatgcctgcaaaaacaacccttttgaagaattgggaaaaaaataaaaaccatttggctgaaacagccctgagaagggcagcttcttccaccactctttcatcattttaccatctgtgggttatccccggggtcactgctatcccagcctaggttttatacaggatggagtacgaagttcccgcaactatccaaamggtaaaatgtgcttaaaaaaaaaaaaaaaaaactcgag

SEQ ID NO: 2985 - DNA, 1238 bp, Homo sapiens
ggcacgagtgaggtttcaccatgttggccaggatggtttgatctcctgaccttgtgatccaccctcctcggcctcctaaagtgctgggattacaggcgtgagccactgcgcctagcctcttgtggctctaatttattatgtagtactctgtggtctgtatattaacgtcttgcctttatcttttatattatatggtaaaaccctgatttttgtattttgaattttcttgtttaattgtacacatttttgtactgatatatcaatagctaatggcctctccccagaccaatggaaattggcatctttttagggggagagggttagattgggtctcaggctctgggaattttttaaaaagctcaccagatagtgctggtgtccagctagaattttttttttggattccacactaaaagcttaggccataaaagcaaaaataaataaatggaatgacgtcaaactgaaaagcttcttcaaaacaaaggaaacaatcaacaaaatgtaacaacctatggtctgggaaaacatatttgcaaaccatttatctgataagggattaatatctaaaattcatgaagaactcatataattcaataatagaaaaataatctgattagaaaatgggcaaaagacttgaacagatgttttttcaaagaagacataaggatggctgacaggtatatgaaaaggtactcaacagcattagccatgcagaaatgcagatcaaaaccactgtgggcgtcacctcacaccccttagggtggctgtcataaaaaagtgaagtgataaccaatgttggcgagggtgtggagaaaatggaccccttgtacactgttggtgggagtgtggattggtacagccatgatggaaaatagtatggaggttgctaaagaaatgaaaaatagaagtactgtatgacccagcaattccttatctgggcatatacgtaaaggaagtgagatcaccttataaagatatctgcactcccatgttcattgcagtgttatttacattagccaagctgtggaaacaacctgaatgtccactgatagatgaatggataaagaacacgtgatatgcatatataatggaatattattcagccttaaaatgcagatactgccatttgccacaacatggatgacctggaggcagtatgctgagtgaaataagccagacacaggaagaaaaatattgcatgatctcatatgtggaatcttaaaaaaaaaaaaaaaaaa

SEQ ID NO: 2986 - DNA, 1117 bp, Homo sapiens
ggcacgaggagaactaagcattaggagaagcagcatggggctcaacagtgaagtgacttgttccaggcgggtcctcaggagtggctgtgcagccccagtcacttttcatcacaccggagagggacgcacaaccccagtcctgtttagttgcagatataccgagaagggagagcccacaccgaccttaaggtcacttgggccctgaatcctatgcctctcgttccactgcttctcagttgccctcctacctggctggccaggtttggagtctctctcccctgctctggcattccagtcttggcctgaagcacgctatgcctctcatacagtctgccttttctagggtccaagcagcatcccaagttctgttgagatgcagcttgcagtccaggaggacaacggtcacccccatcttcccatgtttttcttgctttaagccctcccctaagctttcacatataatcaccaggggttcagaaattgtcagccagttctccttatgctttaagtagattttcttggggccagatgtcttgaaaaacgctctcctgactcagcagttcctggaatttttggcctatcatttatctcactgttctgagtttacttgtaagcctcttggcttaatgtttgaatcaagatgagcagtaataacagcttcttgtgtaccaattactcagaactcacttaaattgccttaacactttttaaatgttcttacacatttgaaattctttagggagggatttccagaactttcctaaatttctccacccatggcatgacagtacttagaggggcaagaagttcaattttagaataagctcttctgggcgcgatggctcatgcctgtaatcctagcactctgggaggccaaggcgggtagaatgcttgagcccaggagtttgagactagcctgcaatatgcgaaaccctgtctccacaaaaagccagacatagtggtgcatgcctgcagtcccagctacttgggggcgctgagttgtgaggatcacctgagcccaggaggcagaggctatagtgagccacgatcgtgccactgcactccagcctgggtgacagggtgagacgctgtcgtctcaaaaaaaaaaaaaaaaaaa

SEQ ID NO: 2987 - DNA, 1640 bp, Homo sapiens
ggcacgagctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggtcaatggggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggcttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaaaaaaaaaaaaaaaaaaa

SEQ ID NO: 2988 - DNA, 2060 bp, Homo sapiens
  misc_feature (8)..(9): n equals a,t,g, or c
  misc_feature (44)..(44): n equals a,t,g, or c
  misc_feature (1938)..(1938): n equals a,t,g, or c
acccgccnnaatttaaaccccccctaaggccaatggtacggccncccttttttttttttttttagaagaaatacggactttaatgaagagttttccctttggtataagtgagacccgtggaaacatccaaacagcaaaaggaggccaggatgaaaacggtcaactctcccttatccacaaggccaaaagagggggggccggcttgctgtggtgtggccaccccgggcctaggctgggccgggcctgtagaaggtactcaggaactgcaggttttgcgtttcccctccatgaaactgacaggcattcgggctgacttctgcctctcagtctcgcggtaagagacccaagtttttctagtcctagatggaaataaatttcatctgcctcaggtctctggtataaaaggtgcgatcccagttacctcacaggcctaggcgaggaaaatgccaagagctgtaaaagggcttggaaaagtcaaaaaggtgatgtataaatgtaataattgattatcattttgtgctcaagaataagcaatggaaaagaaaataggaaagtaagtctacagccctaaaatatatgcatataaaactttaaaagaatgcagttccaactctacagatggtatgtggggattgtctactgctttatagtctcaatgccccttttctcacctccacaaaatccacctgggagagttaactgtacaagaggcccaaattcagtcacccccaccccgccctcccagaaagggaggcagggcagaggcttcaggaggaagggctgcactttggcgtagagtacataggcatgcaacatgggagggcaggccttatgaaatgtatatacagaccccttggggtgaggggccccggccaggaggcactgagcaagggaggggtccatctcccgcctggccgggagtggggctctggggcaatctctaagggttgcatatccccagggagaggggacagctgccactcctgcctctgttatcccaacccaaaccggagagggtgctcagcaagaacacaggtcccagaagccaagaaggtgttggcatccctgtcattgaattcaggggtccaagaactgtttgcataaaatatcattagacctaagagatggtcaaaggcacaaagtttaaacatggggggggcgggtgttgagaggggtctgggataccctgaagcccagaggtgtgatttgttcccccttgcccagaagggtgactgttccactgggcctgtcaccacaggacattttccatgacaagcactcaccttcttggggaaggggcatcaggttggcacaggaaaggcccaggtgaggggccactctgtacattaatactttggtgattaatgtttggggagaggcaggattctcacccaggcttttgactcaaaccctctcactcagctggatatgaaacccagagtccatgctactcccagctctgacacaaggccaagcccacagaacactcccaaacgaggtcccgagagttagggaatagggtggaaaggattggagggcatcttctggaagagagcgctagggcagatcacagtttccgctccacaggttgctgtagacacagttcgctgccygcagagatgatgggcaagtgattgtccatgtggtagctgataaggtgactgacactttcaaagcggtgatccttagtccgaacctgggagggtgggaaggaagaaggtcaattcaggtgaagagtcaaataagacctcagcctccaaggtggaagagggtgaaacagacmagaggcttgaaggaggagaaaaaaatggtgggggagagtgtggcctgtcaatcctgatcattgaggcttctctagaaagagacagttgtaggaatagacaggtcagtgaagtgagaaaaggcaaaggcgacatcagccctkaaagagtgaagctnagagctatatacccctttcttgacctggaggaagttggcatgtctcagaagagtatacacagtgcaaaaaaagatgtggaggctgggcatggtggtccgtgcctgcaatcccagcactctgg

SEQ ID NO: 2989 - DNA, 823 bp, Homo sapiens
ggcacgaggcaagataaaaatgctttcaaagaaaactaaatgaagacacctccccagatatttactcggagatgtattagtgcttaacatccaataggaaaattgagcccattattcataatacacagaaagtctcattgaactcaagcacattctatgaagctggcatcaacattccttcaaggaattcctacagctggatggattgttccatatgaggattctctcactgcaataatagctttcactccagggaggaagctgtattcccttcatgctgttgctggtatttttagactgttaaactcttcagttgctgaagggtatccatttaccacatatttattaggctaccatatgggtagtcagtgaagggtgaagggcattgactgttggtatcctgagtgtctgagacgcctttaatccaaagatctcaaagtactccaccaactagaaatcactccccaaccctggagcttctttagaatgtacaaaatactggcccagttgtcagtcattaggtaaattttcagactttttttttttttgagacagagtctcactttgtcacccaggctagagtgtagtggcacgatcgtggcttactgcagtctcgatctcccagctcaggccatcctcccacctcagcctctcaagtagctgagactacaggcatgcatcaccacgccctgctaatttttttatttttattttttgagacggagtcttgctctgttgcccaagatcatgccactgcattccagcctggacaacagagtgagactccatctcaaaaaaaaaaaaaaaaaaaaaaaaaaaaaaa

SEQ ID NO: 2990 - DNA, 938 bp, Homo sapiens
ggcacgagagaagttgtcctcaactatcagtaggtttttagagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataagtatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgactgcaaacctccctgacaatttttaaaagtagtaagccacattacatttatctttgtaaaaagatttatggtaactggtttcttacttgacttttataaatagtattttacatcttaaaaaaaaaaaaaaaaaa

SEQ ID NO: 2991 - DNA, 1896 bp, Homo sapiens
ggcacgaggtaaattattggttggtaagcctcttaagtcttaaaaggtaggttcccctccatctcttttttatacaaaaccaactttttactaggctttacttctgaattaaattcaagcggcggctattgacagcagcaagaacctttgctgtcccacgcgttcctcctgcagtgttctctgtgatgctgcttggaaggctgatggactgttcagctggtgtgatgatttgggtagctcagagccctcatggttggggacctgacacatgaagagccctgaatatcactatgggtgagtgtggccttactttttgctgcttcacattaacggtttggctttgcctgcagccagtattctgaccttaatgtcacacttgcagatgtcagcccaggcttggtacaggggcaaaccttttcaggcttgagcagaacccagttaggttccgggtgttgactgttctagaaatggatttccaggactacatgagtgggttcgtgtgttttccccagaaaatccagaactgatgataaatagaaatgtgaaaaactacttcagttacttgactgtttgttagtaaaaaaaaatcagtaattcatccttgcccacctaggtaggcggtttatccaacttctgggtctcttgcccatggaaatcaccatcttggatctgttgctctcccagaacagtattatgaatagggctaaaggtcagaatacccccactgcccttatgacagatgggaacatctcccaaataagacagtctcaagcattcatgtaataaaataactttattagaatcaggaatttgttaaaataatatccttcacatatagctaaagtgcaaattctcttgctctgtagtagaagcaagcacatctgtcagacctccgtggtgtgcttataaaaccaagacgagaagagttttaagaagtacctctggcagcataagagtacgaaaacacattttataaaggtttgaacaattaccatttggagccatttcatatatcgtgtatgtcttttcacttatttttcttaacctttcaaaaactactctgtgctatttatacaactgaagaactgtataaactactttagagcagtggcctcattactgtcaggaacggaattaccaaatcaaagagacaacactgcgtattcgccatcactcacacactgacaaagtgcagtagtgttagacatcatgggctctgtcactgggaaagggacccagtgacttccacctctctgactctaaatagcagcagtcatattggcacctgtaccatatgattcaaagagaagattctacttccattggatgacagcttggaaactcggccatattacatagagcactacatcatttcacaagttgcgagaaaaataaggccactccgaggcaatctcttctgcctcccagggggatgggacacgggacagtgcaaagaccgtggaagatggcagtaagtagatgaaactccaggaccaaagggatgcagcctggccatggctgaaggtttttgctccattcagtagaaactggtgctctaattcattatcaaaaatgcttacttggtgtccacatggcatttgttttctcaggttaacatctgcctacagaaaactcaggcagaggggtgagggcagatgcctactagcataacacctggtttgcagcacgatacaggtggaatgacaagcccagagaatttcagacgaaaacatctggcctgagttgctacaaatgaagtgtgagagaaacgcggatacacaaagaaaaccaaactgcccgcccaccatgtttccccctccaacatacagctctttatggctaccccctattcttaattagaaaaatagtctcaatatgaaaaaaaaaaaaaaaaaa

SEQ ID NO: 2992 - DNA, 1494 bp, Homo sapiens
ccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactccaaaaaaaaaaaaaaaaaactcga

SEQ ID NO: 2993 - DNA, 2836 bp, Homo sapiens
  misc_feature (1615)..(1615): n equals a,t,g, or c
gcgcctcgccgggtctccgcttatcacacctcaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccagagtcccttcgcacggagatcccaatgaacgcgggcccctggaggccggtggttggggcttctccgcgtcggggatggggccggtaccctarcccgtttccagcgcctcagtcggttccccatgccctcagaggtggcccggggaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcantttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgawaaaaaaaaaaaaaaaattccggaattcgatatcaagcttatcgataccgtcgacctccga

SEQ ID NO: 2994 - DNA, 1073 bp, Homo sapiens
ggcacgagaaaaactcaactcgtctcacaactcagaggtacaatgaaaaggagtttttccctctgtgattggaactttctcttgagccctttcccttaggggatactaggagacaattacatctctaattcaacctaagtttattcccttttagtggggttcaatttctgttagccaaaagtgctcagtccctcaaacagcttatcttttgttgtttctctaagattgtgtagaatttggaaagggtatagcttatttgaccttatggctttgtgcggaagccggggtccccagtagatctcctggcttctggataagtttctttgctgctgggttgctaggtgcctcattggcctccactgccaacttctgggtggttattacttagggttgtgactattgcttgggcaatgcacctgcaggtgctttctgggcaattccatttcatccggctcttgatggcaacatcagcaccttggggacactctgcgatatgtgttttgcttctgttttttgtcccggattttctgcagggtcccctgtctcaataaggaaaactccttctatcagtttatccagggtaggcaggcaggtacttctaggtccgacgcagtgtgcctcagtggaccaggatcatggacacaggacatgggtaagttcctgaactcctctctgcctaaggttcttcatctatcaaatgaaagtagtaatagtgagtattcactgaacacttcctatttggctgcactttttaatgtgtttcatattatgatgtgccaggcagagctctgtaataagtcagtgcttctcaaactctctgtggtaaatgattaccttttttcttgaatttccaatttgccacagatcaatatttctgcaaagtactttaaaagttacttcctatgagcttttacagtgacaaatgaaaattttaaaaaaaaccttaaaattgaaatcactgtacaaattagttattggttataaattactacaaacacttcaataaatatttaacaaataaaaaaataaaaaacttaattcctagaaaatgacataaaaaaaaaaaaaaaaaa

SEQ ID NO: 2995 - DNA, 1290 bp, Homo sapiens
ggcacgagttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgtcatggcctgtcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaagctggaggtgggtacccactgctgtggaacgggtatggacaggtcataaacctagatcagtgtcctgttggtcctagcccatttcagcaccctgccacttggagtggaccctcctactcttcttagcgcctacctcatacctatctccctcctcccatctcctagggatggcgccaaatggtctctccctgccaattttggtatcttctctggcctctccagtcctgcttactcctctattttaaagtgccaaacaaatccccttcctctttctcaaagcacagtaatgtggcactgagccctacccagcacctcagtgaaggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacaaaaaaaaaaaaaaaaaa

SEQ ID NO: 2996 - DNA, 1629 bp, Homo sapiens
ggttaaatcaagatataataggtatcactaccctgtttctttcaagtcttttgatggtgacattaagctctttaattcttgagatgtggtattgcttctggcttaatatcttagtagggagggtaagttctaggggcttccatttagcccttactattaaaatgactcttatcagttgggtcagaaagccaatatgggagctctgccaatagtcaagtatgtctgttccaagtatttattcaggaactgaggagatamcaacaaagtaggcccattgtactatggggtccactgtgaggtggacttgagctaagcatttcatctattacctgaccactgtcagcactcactttgactgataggccacagtagcattttgagtccccaggaattagtaatccctgaaagtctgggtatttccttttctctaatccgtagtcactctagtaaatggcctttggggaagcttggatgaggatttacagtatgtacttgtacttgtgggaacactacaggtttttcctcaggggacctgggcttgttaattgacttgggtctagaaattagatgagaggtcaaaacttttctagtccaggttttcactaccagagctggagttttttcagttgtacagatgaawcyggtttggtaggctgcttgtggaatactgtgtgatcaattactgccaaagatcctggtgggccaaggtgttctgattaccagtacaactttactgtatttatagtagatttcccaccttgtctttggtgattacatgctgctacttggcctctgttattttaggatcccgttacccctttaaatcagggaacccacttagtggtggcatttcccatggccatacctaggggttgtgacagagaccttagggactgtaaaacctaaaatgtttatctgtggccctttataaataaagtttgccaacccatgtctaggggaacagggacacactgcaaaggggagcaaccacagagcttttcaaggatgaaggtgatcccctcactaatgcatttctttttttgttgttgtttgttttttttttgtttttttgagacagagtctcactctgtcacccaggctggagtacagtggcacgatcttggctaactgcaacctctgcctcctgggttcaagcaattctcatgcctcagctactctggaggctgaggcaggagaatggcttgaacctggaatggggagcttgcagtgagccaagatcgtgccactgcactcctccagtctgggcgacagagcgagactccgtctcaaaaaaaaaaaaaaaagcattcataaaatgaaactaagcggggaaaggtaggggagagtcatggctctcctcccagcagagtggaaatctttagatggtaattaagaaatgggatgaccagcctgggcaacatggcgaaaccctgttttacaaaaaaatacaaaaattagtcaggtgtggtggtgaacttctgtgggcccagctaactcaggaggccaggatgggaggatcacttgagcccaggagtttgaggctgcagtgagcagtgattggacaactgcactccaacctgggtgagagagcgagagcctgtctcaaaaaaaaaaaaaaaaaaactcgag

SEQ ID NO: 2997 - DNA, 1610 bp, Homo sapiens
ctgatgcagagatggaggatgtcaataaccctgggctcagggtcagagcccagcctggggactatgtgctggtgaaggtgaggagtccttttgggcttttggcttgcactgtgaaatgagtgttggtttggatatttgtggtaataaagttttttcctagagacacattttagtaaaataaaaatcccctctcaaccagtacaatggaagggcactttggattggattttagactgctccttactaatgccttcttattcttcttacctattctcctgccctggaagcgttctttgtgggaatttggtgagtttggagtatgcagtggcatgtagtttctcgctgcagagaggccaggaggtggagtgatttcgagtgagtagagagtgttccctgttggagatcaacattttctttgtgatctctgacggctcaggcctctttaacttacatgtgctcgagtttcttgggtctcttccctggactcacagatcagctatatggctgtgggattttctctccctttctttctctctttctttctccctttcactggcgatatgcttctcttattgtctccttccatttcttcctttctcctgccttctcttctcacactgcccagttctgctactgccaccttccctgtcttgttctcatatctgcttcgcctcagaaccagaagctggcaggacacagactgatgccctagagcatccacagaagttcctttaagggcagggaaaatgcctgttttgtttctgtttgtttatctttgtttatcttctagcacctagggcaattccgggtacaaaatatgtacttagtaaggatttactaatggacygacttgctcttatgataagacatgtgaccacagataactttggggtcacattcttttagctctcaattggaggaragagaacatttctcaccaaatgttggctgtaaatatcctaaggaaggatttgactggatcagccttggagttaggagggcagggcctgtgatgggcagtttcacctgaattttatggttagagctgaggaggagccatcttccaagagaaaagggagaagtggctgggactgacctgctttgacttcttaaattatatccattgccattccatgagacctcgctccctgccaggatcgggggcacacaggagccatgtggtctctgccagccggtcgcctccatcagattccttttgggggcttctcctctagaggctccacatgaagtcccagtgctacagtcctagttattttgccttcttctgcctggttttctttcagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaaaaaaaaaaaaaaaaaactcga

SEQ ID NO: 2998 - DNA, 1945 bp, Homo sapiens
ggcacgagcccaactgagccctacctcccttaccaaagaagttcatggccaagccatttttatttagcaaataagggcttgttttccttgattgtccaaagcacaaggggagaaaaaccacccattggcttcatgtttacctgcactgcggggctgtcttgtctgtttcagttctgtttcacatgtggagttttcactgatttcaagaaggaatgtatgcatggagttgagcaggatacagtatcctgaatgagggctgaatgttctgcactagaagtgagcgtatcaagtctttgtaactaagaatgtgatgttagattgtagctgaggggaagaaacacaaatggcttgggttgtatctaaatcctgggtctgccaggtgaaaacttagatgttgctttcaaatgacactaatgatttctttcagtgctgtttagcatgagtggtcattgcaaagagctgtgaccactgtactacccagtatggtggctactggtcccatgtggctcttgagcacttgaaatatgggtaatctaaatggagatgtggaaaatacaaactggattttaaagacttagtagacttagtattttgaaagagcaaaatagcccattgacaattttatgttgattatacatacattaattttacttgttatcttttaccatttttaagtgcagctactaaaaatttaaaattctgtatgttgcttacattatattgctcttggacagcactatactaaaggcataaatgtaagattgtgtttcagagggcacccgagcactgcttggtttatatgtattttctaggccttccctttggttccctggttacctttaaaaatacatgtcatgatatagacatggcatatctgagacaaaccttggactgagacaaacctgagtttcaatctcaattgtttgtttgtggcttgcctctcagcatcttaaattctctgaatcttaagttcctccactgtgtaaaagaaataatatccctctgacctcactgtggttaggcaagagacaatgcagtgattttttcagtaatattatgagacattttattactataattaaatgattgtattttccccagattgacaaattcaaattttctattttgaaatcttattgcaaatgttaaaaaaacaaacaacccaccctttggctcctgttatgttgtcttccagctgctagtaatggaattgggacagctaatgttccctgagagccatggggaaccaggcagtgtgcttttcaggaactgtcttactttatcctcacaacaatcccaaaaggaaaaacctagttttatctctatttaatagctgcagtgactgaggcaccgcaaggttaggtgacttgcccaaggtcacacagcgaagcattgagcccgggcagtccagctctagagccgtgttctttgcctccgcccaatattgtccaccagtgaggagaagacggaaccaaagaaccaacagtgaatgaatactaacaggaatcctggctttcatggacatctattcttgtgatttgacagtgtatatgtgagatacttcctcttagaatgctttttctaattcatacagtaggcttaaatatgtcatggttttagagttttccttaaggaatacgttgattcccaggcacattacagtctgaatcagtcttaagaaattccaggatagaggtggaagaagttttagtaaattgttgtgcagcatggtgaccgcagttaataataatgtttatatatttcaaaattgctgaaagaggagatttcaaatgttctcaccacacccacacacaaaaaaaaatgataagtaggtgaggtgatggatatattaactagcttaatttaatttttctcaaaatatcacattatacttcataaatacattcaattattattagtcaattgcaaaaaaaaaaaaaaaaaa

SEQ ID NO: 2999 - DNA, 1455 bp, Homo sapiens
ggcacgagctcgtcccggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgccactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtagttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgatttacttgaaaacaagctccatcccttttctatatttataagaagagaagatcttgagtgaagcagcacgcgacccaggcgtgtgtgaattgaatggagacgcttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggagaaaaaaaaaaaaaaaaaaa

SEQ ID NO: 3000 - DNA, 743 bp, Homo sapiens
  misc_feature (718)..(718): n equals a,t,g, or c
gtcctgawcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccactcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattamcctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaaggaaaaaaaaaaaaaaaaaaactcnagggggggccggtaacaaattcccc

SEQ ID NO: 3001 - DNA, 715 bp, Homo sapiens
gccccttttatttgcttcattgtgcaatggtataatttttatgcttttctattttcctgctttaaagagcttttaaagtttctgaggctctgccaaggtgttattacatttaaccctttgtccctgctttcttttctggtcctgaggtctcctattggtgtcacaggcaggtgctttgcatgccaactctgatttatccctgatgggcccttatgacgatatgaggcaacagttggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtttgttttgctgatagaaggtctggaacctggggcgctccctgcattccctggctctcccagcagtaggcatgggctgacggtgtcccatgtggaaggccttggctctctcatgaagtgtggcctgtaatcagcctcagcggcaagcctttactgttctctggttttgtccggattctcttttgtcgtctacaccctgacccatgccctcccaggccctggctggggctgtactccagagcaataggcttcccagaatctccagtctcacttccatagcaccagtggaggcttctgctgccacaccctgtctggaggcactgacctccctcga

SEQ ID NO: 3002 - DNA, 1040 bp, Homo sapiens
gtgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacaragagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacaycaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaaaaaaaaaaaaaaaaaaaaactcgagcc

SEQ ID NO: 3003 - DNA, 3511 bp, Homo sapiens
  misc_feature (779)..(779): n equals a,t,g, or c
caccaagtgctcctccacccctgataacttgagccggactcagtcaggctccagccttgccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcgscgrcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaantgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatgctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccckgcgttcttcakgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaacccaaakgattcaatgtatggatgaagtttatgtgtaaatccttggtaatgctagaawtctgggagccccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcacgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaaaaaaaaaaaaaaaattc

SEQ ID NO: 3004 - DNA, 2058 bp, Homo sapiens
caggaattcggcacgaggtccctttggagtctgttaagcccagcagcctgccgcctctcattgtgtatgaccggaatggattcagaattctgctccacttctcccagacgggagcccctgggcacccagaggtacaggtgctgctcttgaccatgatgagcccggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctccttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaccctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtaaaaaaaaaaaaaaaaaaaaaaaa

SEQ ID NO: 3005 - DNA, 840 bp, Homo sapiens
aattcggcacgagttggctgcggctggtcatcttcccacctccacagtgggccgagctgccaaacaaggggtacacatgtgccccctgacataggccaggtggtctctgccctctgtagctcccatgagagagggctcctcggaccgaaacaggaggccactgcccttgcgcacacaccgtggccgggtcctcctgggcggagcgctttccgtgtgtgggaaagtcaagggcagccccgagcctcgaagcccaggctcccagccccgcgccatgttgcattcccgcctctactccttggtaggctggttgctttgagtggttctttttaattctttctgttggtttctccttttcctttgcctgggttttgctttaacctctctgttgcagagatgcagagcactcagagagcctatttctatcatcgctttcctattctccacctagaaccaggtgactggccgcccgagtggtgtctcttgtgtgtgtggtgcgtccaaagctgtgcaagaaatgcttctgcctaggttttctcgcgccccccccttgccttggcttttcctgcctgcttacacccccgtttccctgatctgcccctgggcttctgggcaggttccccgcactgtgcctatcgccgggcctgtaagtaagcaaactgggcaaatgaggggctgtgtctggaatttggagacgtcacatttaaatcttaaaacactgtaatcccagcaatctgggaggctgaggcgggaggattgcttgagtccaggagtttgagaccattctgggcaacatagggagaccctcatctctacaaaaaaattaaaaaaaaaaaaaaaaac

SEQ ID NO: 3006 - DNA, 2387 bp, Homo sapiens
agatggcggcgctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctktgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagartgcccgcactcgccttcaggaaatggaacgccgattccatgagcttgaggccatcattctacgtgccaagcarcaggctgtgcscsaggwtraggagtatgagaagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaaaaaaaaaaaaaaaaaaaaaaaaaaaaaaaaaaaaaaaaaaaaaaaaaaaaa

SEQ ID NO: 3007 - DNA, 2064 bp, Homo sapiens
  misc_feature (1596)..(1596): n equals a,t,g, or c
  misc_feature (2005)..(2005): n equals a,t,g, or c
  misc_feature (2047)..(2047): n equals a,t,g, or c
  misc_feature (2057)..(2057): n equals a,t,g, or c
ccggagggccgctggtgtctgtgtacagggcgtgctgtctgtggaaacgcgagggcacactagcactttcctactgcstctgtcaccgggtccctccacccttgtctcctgtgcggccagcgtcagagccatggcgacggaggagaagaagcctgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagtygacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgcccnggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgargctggctgcamctgctctctgaagacgccttcctytctaggttcattgttaatgttgctggrgccgggnaacggggttgggaagttcttaatttcccaaggagccagcccngatggacttnccttgga

SEQ ID NO: 3008 - DNA, 1127 bp, Homo sapiens
gctgcactccagcctgggcgasgagwgatattgkcactgtctsccccttgctaacctcctaggtgcttaggataaaacgtcaaatatttaacatggcttcacagacatcttgkatcatttggcccctggctaccttacctcacccaatttcctcctttgctctgtactctagctacactgkccgaggagttcctaaaacatcacgctgggtccgaccacaggatcttcacatgtgctgctccctctatctgcatcgctctttcctcttctcttgtttgcttaactcctacttaccctcgggcttaatcagcactttctcacctctcctagtctgttgctcttatttaagatcaaacagcagagaaatgtgaagtccactgacttccgggtggaacagggttcagtatgccaattaaattattgggtgctggctgggcacggtggctcacacctgtaatcccagcactttggaagggcaaggcggytagatcacttgaggtccaggagtttgagaggacaacatgatgaaactccatctctactaaaaatacaataattagccaggcgtggtggcktgmwcctgtattcccagctactcaggagactgaagcaggaggatcacttgaacctgggaggcagaggctgcagtcagccgagattgcatcactgagctctagcctgggggacagagtgagactctgtctcaaaaaaaaaaaaaaaaagttatatctaatgtgctcagaagttaacaatagaccaaaatttcatcaaggctgtgtgtgagggtattatctagttacagattacagaggcttggctgggcatggtgacttaacacctataatttcagcactttgggaggcccaggcaggaggatcgcttgagcccaggagttcaagaccagcctgggcatcacagcaacaccttgtctctgcaaaaaataaaaataaaaaattaactgggtgtggtggcatgcgcctgtagtctcagctactcaggaggctgaggtgggaggagtgcctgaacccgggagttcaaggcagcagtgacctatgatcgagcccctgcactccagcctgggcaaccaagcgagaccctgtctctaaaaaaaaaaaaaaaaaactcga

SEQ ID NO: 3009 - DNA, 772 bp, Homo sapiens
ggcacgagcacaagccgcggagtgtcagtggccactgcaggggatgtgcctcttgtggtcttggctctgggtccagcctaccttaaggtgtgtatttatcttccactataaaaactacaaacagctatttatttccaggcaagagttttaagaagaaccaaaatgcccccaaatctcactccactattgacggtttaaaaagtgaccacgtacgtgtggtgaaaaggttacaatagtgccagaaaaagcagcgtctgagcacccagggtcccatgcgccctgcttccctcgaaggtcactcttagcagctggtgcacatttccagagcacagctgggcctctccacaggcgcacctcagaggacctgcagccgtggttccagaccactacggtagagatacggcaataaagcgagtcacacaaatttcgtggtttcccagtgcatatggaagttatgtttacaggctgggcaccgtggctcccacctgtaatcccagcactttaggaggctgaggcaggcagatctcttgaggtcaggagttcgagaccagcttggccaacatggtgaaaccccatctctactaaaaatacaaaaaaattagctgggcgtggtggcgcacgcctgtagtcccagctgctcagggggctgaggcaggagaatcacttgaacccgggagacggaggttgcagtgagccgagattgcgccactgcattccagcctgggaaacagcccgagactccgtctcaaaaaaaaaaaaaaaaaaaaaaaaa

SEQ ID NO: 3010 - DNA, 1014 bp, Homo sapiens
ggtttaacataaatcaaatagttccaatgggttgcttcatatttgtgtgtactttaaagtcatgccagcttaaatgactgtgaggtacaatgtgttgactttgagttttgtaaattgataatttgttgctatgaaagttgtccatggtataactcatcactttttgaaggtacttagtatgtctgatactggcaagctgtcatgaaaaaattgatgcccagggaattccggggttttgctttcagatgtttgacatgtagatatttaattcttcttaagatttccctggacattgtcagtgtaaggtgtactgatctttaaacacaaactttagtttgggctcctgtttctcagcattctttgggataataatctgaatggtgtattctcaagttttttttttttttttttttttaagtgtatgaatcaccttggggatcttgttaaaaggcaggctatgatccagtgggtctgggatgagtcttgggattctacattttcgcaagctcccagataatgccagtgctgctggtccacagacagtactttaagcagcaagacaacactttgatggacaaagtggtgctgtgcaacacccatcacatacaaattaccagttgctttcctcattgtgttttggtgcatctaaagctaagatgatctggtgtatattcttgactcttgggtatccctgtgagcattaatgaatagtttaacaaccgaccatttggtctagcatgtatggagactaccaagacaggcttattgtgttggaagaagtgatgcttatgtttttagactcttatggaatataccaattcctgtatgttagccaaggttcttgctgcaaacagaagtgaatacaacaaactgctaacttgaaaagatgctgatagaggggttagaaaggcatagtgctgaatcaaatgtatttattttaactagctctgttcatgatggctggttaatttgggcaaaaagatttattgatgaatcatggagaaaaagtgggaa

SEQ ID NO: 3011 - DNA, 1642 bp, Homo sapiens
  misc_feature (5)..(5): n equals a,t,g, or c
  misc_feature (957)..(957): n equals a,t,g, or c
  misc_feature (1578)..(1578): n equals a,t,g, or c
gaganagagagaactagtctcgagcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaagganctctgcagaagaatgcctcagcaagagagaactgagctcgcggtggattttccttagrgtatttatggaacttaaagcaggagcttaagggtagtttggsccrtattagccaataggycatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttntcttgcagactataaaaatatgctttttccacaatcatttaaaaaaaaaaaaaaaaaactcgag

SEQ ID NO: 3012 - DNA, 1534 bp, Homo sapiens
ccacgcgtccgcggacgctggacctttgccatcttcaacatagtcacacccaaaccagattccttggtgccagcttagatccctcactgtatttcatacctaatgcattaccataccctgctaattttatcttttaaatcttgcgtttctcctctccagtctgggcgacagagcaagactccctttccaaaaacaagcaaatgaaaaaatagagttttctctatcacacaaatgggaaggtttgtattgaatgttatatttatcctctatccagtcttgtcttgggagcacaaagcaaaaaggcccagcatcctccactatcttctgaaaacttgccctcaggcctgagcaagagggctgcccggttgcttccatgtagccagccagcatatgtgcagggccaagtctagagggaggagggggtggcacatgggatggtttcgtttaattggaagacagtgggtagatttggagctgggcatttgaaagatgttgagagttgtggatcatgggcaagaaaagcgctgttctgggactgcggggcaggaaaaggaaactgatgcttctgagggtgagtctgatgagataacatgcctgtgtgtgggcctcaggttagacagtgctkaggtctcccgtcactgggcatccagctgggtctacggccgtggctcctgccttctgcarccctgtcagggcccaaggccttccccatcagcacttgctccagcctactcactggaakttgtgttctgggtgggkgtgtagaatactcgmactcytacttggggcatmagggagctytytagcaatttcttctgcacctagggagagcccactgtaaaaaaggcctagycaaatcctcaggkgtacatggacatcaagattgggaacaagcggttggctgatcaaacctcctggttccgacgtsgtgcccatgaccacagagaattttctctacatgtgcacccatttaaaggactcggcttcaagggaagcagcttccaccgcattatcccccagttcatttgccagggcaggatttcacaaaccacggtggcaccaggggtctgcgcaggcatggcactaagtgtcccatggcacatttggccctcatggaggcctcaaaagggcaggaccagcaccctcttctacggaggaaggaacgggcacagcagggtgagccactgcgcctgatcaaggcatcaccgttgaacctcctaagaggaaaacataaggctgtgcaataccaggaactgggattctagaaacaaggagagtcagcaattaccagccagccaaggtcctggaagctgacgtagagctcgtgccgacggcagacctgccggccgtgggagccgcggacgtcatctgtcagggacagaaggggcaaggtcttttctggggttcctgctgtgtgcagctactatggggtaccagggtgggggatgccctgatgagcacatttgtcaaataaatgaatgacaggaaaccaaaaaaaaaaaaaaaaaaaaaaaaaaaaaaaaaaaaaaaaaaa

SEQ ID NO: 3013 - DNA, 857 bp, Homo sapiens
gcccacgcgtccggtataaatttagcattaccagtggattctgcgtattttatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccataktttatccaacctaaacaaagagctagtccccaagcacactaacccgttacattcatccctctgcttttaatacaattgttcctctatagagaatacctttaaaaatatatataagttggctaagctcaaaaacaccacttctatgataatactcttacagattcttccatttgtaaatatgcatgctcatagtactcttacagcgttggtcctctcttataacawtgttaragtagatactgtaaactgaaaagtgacacataaaaatacataatggtgcagctcaggtatgtgtcatcttaatattcctattaaccttagaactttgtgactgtgttgggattacttgacatatttgtttatcaatcamcmcagtgacagtgacgacgawtkagtaaccagtgttttgtttttgaaacatttgaagaagtgttccatatttctgaagttattagtttagtttagtttagtttagtttagtttagtttagtttagtttagtttagtttagtttagtttagttttaacgacagagtcttgctctgttgcccaggctggaggttgcagtgagccgaggtcacgccattccactccagcctgggcaacaatagcgaaactcagtctcctaaaaaaaaaac

SEQ ID NO: 3014 - DNA, 819 bp, Homo sapiens
  misc_feature (814)..(814): n equals a,t,g, or c
ccacgcgtccgagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaaaaaaaaaaaaaaaaaaanaaaaa

SEQ ID NO: 3015 - DNA, 739 bp, Homo sapiens
cagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaaaaaaaaaaaaaaaaaaaaaaaaaaaa

SEQ ID NO: 3016 - DNA, 1537 bp, Homo sapiens
ccacgcgtccgcggacggtggatgacaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaagggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgaccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgccaaaaaaaaaaaaaaaaaaaaaaaaaaaaaaaaaaaaaaaaaaaaaaaaaaa

SEQ ID NO: 3017 - DNA, 2146 bp, Homo sapiens
  misc_feature (20)..(20): n equals a,t,g, or c
  misc_feature (38)..(38): n equals a,t,g, or c
  misc_feature (2125)..(2125): n equals a,t,g, or c
cgtgcccagcctattcatgnactcaactgggatctggncacactgcactgggtgttttgttctctgatgtgcacattgatgaatgcatattggtacaagggaaatgaatctgttttcagccatttaaaaaattgtgttgtaaaggcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgytctgttcaactaatagagaacytacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaamcctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtaaaaaaaaaaaaaaaaaaatntctcggtccgcaagggaattc

SEQ ID NO: 3018 - DNA, 1384 bp, Homo sapiens
gagcgtggataatccagaaaaggggaaaattgaaaattagtagtgttgtgtggaggaactgacactgaattagtgtggtctttttatgcattcggccattgttttgtcattgctcctcaattgtttccctactgctggacggaaaatttagattgtcttattcagaaaaccaaatgcctttctattgtctttccttattattattatttttcaaattaagttgatgtctcttttgtcaggcagttgaaaaatatgttttatgaggattgtgggttttgttagttcttaccacactgccacgccacactcagtttgagaaatacacacacgacaactccagactcatttcagaaatatttttatccatgtttacctctgcagctggtgcagatctcaggtgtgcaagaaatatttctttaaaaaaaaaaaaaccaaaaacaaaatgctgttttatttgtattttargacatttctgcctaagtcatctgggtarctcagaaatctctgttcactgcctgggataggtttatgcaattttaaatgttacataaatgaatgaaataaggtgaacatagtcattttttaaaaatagcattattatttttatgaaaaataaatagaatgctttggattcataaaaaggctatatttgcaaagtacttaactgggtatgacattggggaaaaatgtttaacattgatgataattctgctctcagatttgaaactgccttcagatttttgttctgctttagaggaacaaaaatggaaactcgggtgaattacgatgttgtttgtgaaaagacatgtctcaaaactctagctaatctgtccaaaaaaaaaaaaaaagcaacagtccccatactaaaaataccaatgaaacaaaaaagccccatttgatcttaaacatatatacatttagaagttttaagttaaatattaaggttatgtgtgcatttaaaaaattatcttactgattgactttaagaagttaacccaccaactactggttcttgtcttgacagggcttttatctacactgacaaaatgaaatactatgcaatcattaaacattctattttattttactctattttctcctattttatgatagcattttataatggtatatgaaggtgctcattatatgtggttcagtgagagagggtggctatagaatagaatgtactgtaccttcccatttttgtaaaaatatgtttagaacaaagacgaatacgatacatgttaatggtgggtagattatggctgatttttatgctctttatttttataattgtactattataaatgctttacttttgtaataaaaattaataaaagtcattttttaaagaaaaaaaaaaaaaaaaaaaaagggcggccgc

SEQ ID NO: 3019 - DNA, 1374 bp, Homo sapiens
ccacgcgtccgcttttagcaaagcttctttaccaagttttgattaaattgcaatataaaattaagttttttcacggtgctatattttgtggaatatgggtagcactcaggtttctttcttttttcttttctccttccttcttccttcattccttcattcctccctccccccgaacctccctccctctcttccttccctccttccttccttcctcaacctcgggcctcccaaaagttgctgggattacaaggccatgagccaccgtggcccggcctatatacccttattcttgattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttataaaagatgttttgtttggcagttatcagtcattataagcaattatcttcaaagacaaaaaaactggactaatttgttgccattctttatgggatgtttacaataaaattccaagttgtttggaatcaattgcactcttgctgctttatgccttaatttatgtaccagagaaaaattaaccagaagaaagaaatatggagttacctattcagctttagagattgtaacatgtaactcttaggtctttcttgtttctttgtcatagaatattttattactattactttttaatctgagaaactaggatgcttcttcctatcaaagaaaaggttttgttttttgttttcatcttagacattgcaaatattctttgggtcacttttaggataataaatatgatgtttacactttaaaaaaaaaaaaaaaaaaaaaaaaaaaaaaaaaaaa

SEQ ID NO: 3020 - DNA, 743 bp, Homo sapiens
  misc_feature (1)..(1): n equals a,t,g, or c
  misc_feature (5)..(5): n equals a,t,g, or c
  misc_feature (25)..(25): n equals a,t,g, or c
  misc_feature (41)..(41): n equals a,t,g, or c
  misc_feature (44)..(44): n equals a,t,g, or c
nattncgcccaaggctcctaaattnccgaccccacctatanggnaaagctggttaccccctgcaggtacccggtcccggaaattccccgggtcgaccccacgcgtccgaaatggtctaacatatatgaggacaatggtgatgatgctccacagaatgctaagaaagctaggcttctaccagaaggggaggagacgttggaatcagatgatgaaaaagatgagcatacttctaaaaagcgcaaagtagagccaggagaaccagcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattaaaaaaaaaaaaaaaaaaaagggcggccgc

SEQ ID NO: 3021 - DNA, 736 bp, Homo sapiens
cccgggtcgacccacgcgtccggtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgaaaaaaaaaaaaaaagggcggccgctctag

SEQ ID NO: 3022 - DNA, 803 bp, Homo sapiens
  misc_feature (767)..(767): n equals a,t,g, or c
  misc_feature (790)..(790): n equals a,t,g, or c
  misc_feature (793)..(793): n equals a,t,g, or c
gagtttatatcagtttcacttcaattttttagggttgcataatttgccacaattttcatcagatattttggaatgatgtagcagaatacatcaagaaaatctccagttcttttgacaatttttgttagagctttttgattcttaccctcatggaaatacttgtgtataaatatagaaaatctcagattaaattattttcttggtagccttgcctgttcctattaagccacagaaaatattaataaggtgaatatgttaactttatttttcaaattattgttaatctcagcatactatgaagaacatgaatgtactgtacacacaaacaacttgatgtctcactaaatgaaagacacatgtgcattagatccatctacctttcaggcacagtcatggggtttttaactccacaacattaactggaattgtggaatacagataagatcataattgcaaagatgtgatattccctgaagaattttttatctatgatcaaaatgcaaaaaatttaatgtgttatggtaatgttccttattatccatgattaagtcacaccaaaatggcacaaagaccaggaaaccagccaagcattcactggaggcattactcagtgtctgagagattcagttgatttatatgaattaaggaatattttactatctagtatgtatcatttaaaataaaacaaaccttctaaagatgataattgtaaacatttgaattgtgtttttaattggaaaagtaatgagcttgtactgttaagctgnttcttattttatgttctatggcnttnttcaccaaat

SEQ ID NO: 3023 - DNA, 1010 bp, Homo sapiens
ccacgcgtccgaaattcttaaccatgggtcagcttatatcgaccttttgggtaaaagacattattcctttgaaacttcagaagcacgagtttgttttctgaaaaacacatgccattgcataccttttaacttgacatatgactgaaacttttgtcttaacaatccattttctacaaagactgcccttatatttattaaagatgacaaaaccaaaaccacttcttctttcatacattttctgctttcatgttctgtcattctgagatctttttttctttccctctctctgtcttcttttcccccagctgtcggcagcatccagcccctccagtcacagtcctcacagagcttcaggaaaggacccctttgcagagctctctttggaggatttcttataaatcactttaggtattgctacttgttgtgggagatggggacttaaatacttaaaaacaattaccaaacattaaacacaattcacgcttctctttcatttctttaaaggactctaggctccctctcctcctcctcctcttcctctattctttaggtgcagaatgaaaagataggacataaggaaaaacaacttttggaaaatatctgtaacataattatttaaagtaatctcatccactgctcacagtaaatggatgagatcggataaagtttgctttttaattaagggcaagtgaatacttaagccctttcgattagaaggattctgcatatgatccacactgcctctgtttgctggaagacagtgtaatttgttcttcttgatgctctagcccccagtttagatataccttctagatctttgggagtttatagtcttctgatttggcaagtttattagcacatctacttcagtaatagatctttggatgggcagtttaagggaaagtgtttttgtatataatgtattttttcacttttggaggattctttttgtataacttcaataaagattgtaagcaaaggttgaaaaaaaaaaaaaaaaaaaaaaaaaa

SEQ ID NO: 3024 - DNA, 1554 bp, Homo sapiens
  misc_feature (847)..(847): n equals a,t,g, or c
  misc_feature (888)..(888): n equals a,t,g, or c
ggcacgagtgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggctcctgtcacctggctatgcccactcatcccacccgtctcgtgctgttgcttcccatagatggcgagcaccttgcaggcagccttctgatcagtactgttctcctagggcctggcacactgcagctgccctgtaaatgttcagctcagcgattgccaaataccagttagggaagaacactggcatctttttctattcattcccccttcaacatattttttgtacttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggactacaggcacgtgtgaccatgccaggctaattttttatatttttagtagagagaggtttcaccatgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccaccacattagctgcgcccctgaagtgtctccagcagaanagatggatgaatggaaggacacacagatggacagagagcangaaagactgttagctctgctaacagtcaggactattccttctggactctgcgcctttgcctgcacagccaagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccagccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgcccttcgggcctccaggatatgtttgcgggggtgggtgtggtgtccagctgttaccagcttctgagctagagctgtactgcctcacgtacacccccacctctgtaaatggtccttgattaaatcgtcctcatattaaaaaaaaaaaaaaaaaa

SEQ ID NO: 3025 - DNA, 1700 bp, Homo sapiens
gaattcggcacgagatgctccagaacttagggcctagagatagcaaacccgaattccaaaatgtctctgctacttatcaaccgtatgtggccttgggtaagtactgaacctcttttggcttcagcttcatcatttatgtgggaattcagctccacatagattctytgatctcctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcacagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaawggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaatttaaaaaaaaaaaaaactcgtagggggggtcccggtacccaatcgtccctsatgagtg

SEQ ID NO: 3026 - DNA, 2058 bp, Homo sapiens
  misc_feature (3)..(3): n equals a,t,g, or c
  misc_feature (2031)..(2031): n equals a,t,g, or c
  misc_feature (2040)..(2040): n equals a,t,g, or c
cantgtctccctatccacccccatttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcctaatagtatcaggttttgatacgtcagtggtctaaaatgctatagtgcaattactagcagttactgcacggagtgcmaccgtgccaatagaggactgttgttttaayaagggaactcttagcccatttcctccctcccgccatctctacccttgctcaatgaaatatcatttwaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaanaaaaaaaaaaaaaaaaaa

SEQ ID NO: 3027 - DNA, 1781 bp, Homo sapiens
gaattccccgggcccggggaattccccggggtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattccwgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagccyggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaaaaaaaaaaaaaaaaaaaaaaaaactcga

SEQ ID NO: 3028 - DNA, 1781 bp, Homo sapiens; identical to SEQ ID NO: 3027

SEQ ID NO: 3029 - DNA, 575 bp, Homo sapiens
ggcacgagccaggagtccttctccagagacttgatccgggcctggagctgttcattgacctcatgctgctcctccacctcacgctgggccttcttcctcaggccgtccagtcgctcaatttcctcttctgcttcatccacctgacgcttcaaagccttcaccctcaggcttagctggtctttctggtcattgacatgctgccgctcgtcttcaatctggatggatagttctttaactttccgctccagttttcgattggtagactgcagaactgtcttctccctctcttcagcctgtagccgctcctgcaacaactgattctgggactcaagctgagagaggctggcactaggcttctggaagccttctgagctggccaaccgggtcttcaggtccttgttctgtctctccaaggagattttgtcacactccaggtcctgccgagcagacctttcctgcatgagctctgtcctcagctgatccacctggtcccggccacgattcacccgatctgttagcagctccacggtgttcttctcctcatctaactctgtttccagccgtgagactttttc

SEQ ID NO: 3030 - DNA, 646 bp, Homo sapiens
ggcacgagcttactgaatgtagtgaccctgctgtggtaatgaacacttctagtgccttctaggcttaaaataccagacaaccccaaataacaaatgctcttttgtgttttgataggttggatttctgtttgcttaatattgggaatactgggggaaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaaaaaaa

SEQ ID NO: 3031 - DNA, 529 bp, Homo sapiens
tcatttagcatattgctgaaagtgggttaaagaggcccaattagtgagatcccagctgggacttttagatgggaaatatgcaggattgccagatgagatcatgggcctratctagtgtttatctgttaaatctgtttataactgcttaactcttgacttgcagacttttaaggcagccatttgacgtcacagggttgggaacgaggcttgtgccagtataaagccgctgtgatgtggggccattgggcccttctgtttttctcaactatgtgcatgcactttggagcttgacaaacagccgtgtccagtgaactccccccaaagaaaattgaagttgactcaccgtgaaaggcataccaccaaaagtgactcctaacccatgtacaattcagaaagaaagcactagttaacaagtgcccagtgtgtgattawttagttctagatctgtccagattttctttgttctggctctgttctcttcatggtggccctgcagtttttagatgttataaaacctccctacgattat

SEQ ID NO: 3032 - DNA, 963 bp, Homo sapiens
aattcggcacgaggttcggcgaagatagggaataaggaagcacaggagtaggggagaaggaagcacaggagtaggggagatatacagcggtcaggataagggggaaagggcggtggttgcgcaagaggtgaaacaagatgtgagagacaaggggtagggaagaaatggggcagcggttaggttcagaagcgcatagaccgtggcggacgggcaatgcgaggggcacagaaaggaactgaggggtgggctatttaaggagatggtcctcagccctctcttttctgcgtaggtctcctcctccaggccgcgcgcggatatgtcgtccggaaaccagcccagtctaggctggatgatgacccacctccttctacgctgctcaaagactaccagaatgtccctggaattgagaagttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcattatgaagaacacttggagaaacatcgaaaggacaaagcccacaaacgctatctgctaatgagcatttgaccagaggaaaaagatgctcaaaaacctccgtaacaccaacttatgatgtctttgagaagatatgctgggggctgggaattgagtacacttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcaaaaaaaaaaaaaaaaaa

SEQ ID NO: 3033 - DNA, 1574 bp, Homo sapiens
  misc_feature (457)..(457): n equals a,t,g, or c
gtacggattcccgggtcgacccacgcgtccggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaagnacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagcygctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcaaaaaaaaaaaaaaaaaaaaaaaaaaaaaaaaaaaaaaaaaaaaaaaaaaaaaaaaaaaagggcggcc

SEQ ID NO: 3034 - DNA, 2735 bp, Homo sapiens
  misc_feature (66)..(66): n equals a,t,g, or c
gaattcggcacgagtggagctgtggtcaactcgagtgtggcagaagcacacagcttgccagcgcanaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccamtccamgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtggggaaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactrttaaaaaaaaaaaaaaaaaaaagg

SEQ ID NO: 3035 - DNA, 1121 bp, Homo sapiens
ggcacgagccagaaccttcctcttttttcttaaaaactcttcttaattgaatccaaagtatcttttaaatgttctacttgtgtaatcatgtcatctgtgaatattcagatttatcttctccttccaatccgtgtacatttaatctctttttctgtgccttatttcgggggctgggacccttcagtccagtgttgaagagaggcagccagtggaggtcttgtctcattcaaggactcagagcaaatgtgttccacatttaatttcactatgaaatataatatttgatgttcagttttgtagatgctatttatcagatcaaggaaagcccagtctatacctaatttgttaagggttttgctttttatcataagtgttgacttttatcaaattcttttttgtatctattaagatgatagatgattgattttcatatgttaaattaaccatggggtaaacaaacttacctttatcatgatatattattctttttgtatttcacaggaattagtttggtaatatgttgggtcaatgtttaaaaaagaaaatgatgtgtaatttttttcttttattgtagtatttctgtttaatttttggtatgaggattattcaggtctcataagagttaggagtatattctcttttaaaaaatatttgctaatttacactcccaccaacagtgtaaaagtgttcttatttctccacatcctctccagcatctgttgtttcctgactttttaataatcgccattctaactggcatgagatgatatctcattgtggttttgatttgcatttctctaatgaccagtgatgatgaactttttttcatatgtttgttggctgcataaatgtcttcttttgagaagtgtctgttcatatccttcacccactttttgatggggttgtttgcttttaccttgtaaatttgtttaagttccttgtagatgctggacattagccctttgtcagatggatagattgcaaaaattttctcccatcccgtaggttggcctgttcactctgatgacctatcattgttggacatttgggttggttccaagtctttgctattgtgaataatgccgcaataaacatacgtgtgcaaaaaaaaaaaaaaaaaa

SEQ ID NO: 3036 - DNA, 1971 bp, Homo sapiens
  misc_feature (1926)..(1926): n equals a,t,g, or c
cgcgtccgccacgcgtccgcgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtgggggktcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaataatgggatgttttattttctgatgtacaaagcttgattaccatagaaaaccatgattttcagggttaatctctttttaaaattatacttcagaagagaaagaaatgctgctttcctatcttacccttcctgctctcctttttgtagtgatgaggaacaatgaaaaagaggtagtgtaaggaattgtgaggctgggcatggtgtaagtgctccactttagagagtgtaccttaattactactgtatttgcaaattaagggaaatttaggtcatcatttgattttcngaaatctaaaaggaactgaccatcattaccaagtctttctatata

SEQ ID NO: 3037 - DNA, 1971 bp, Homo sapiens
  misc_feature (1926)..(1926): n equals a,t,g, or c
cgcgtccgccacgcgtccgcgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtgggggktcacttccgcatggggacgctgctgagccggcagarcgtgcagctgcggctcaagarccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaataatgggatgttttattttctgatgtacaaagcttgattaccatagaaaaccatgattttcagggttaatctctttttaaaattatacttcagaagagaaagaaatgctgctttcctatcttacccttcctgctctcctttttgtagtgatgaggaacaatgaaaaagaggtagtgtaaggaattgtgaggctgggcatggtgtaagtgctccactttagagagtgtaccttaattactactgtatttgcaaattaagggaaatttaggtcatcatttgattttcngaaatctaaaaggaactgaccatcattaccaagtctttctatata

SEQ ID NO: 3038 - DNA, 1986 bp, Homo sapiens
gcagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgtcaggggaattgcttgaaccagggaggtggaggttgcagtgagccgagattgtgccactgtacaccagcctgggtgacagagcaagactcttatctcaaaaaaaaaaaaaaaaaa

SEQ ID NO: 3039 - DNA, 1340 bp, Homo sapiens
gtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaagtaccagacctaaaactctaccaagctactaaaaccattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaaaaaaaaaaaa

SEQ ID NO: 3040 - DNA, 719 bp, Homo sapiens
ccacgcgtccgcctgcacgcaacagaagaagtcctcctgtcaggcgccagagaggaagaagggatcgtctgtctcgacataattccattagtcaagatgaaaactatcaccatctcccttacgcacagcagcaagcaatagggagcctcgagccttccaccctccgaatgtatctccccgtctgctacatcctgctgctcatccaccccagcagaatgcagtcatggttgacatacatgatcaggtacaataacagaatgtcttggaaatacagaagctgaaattttgtggcagtttgagattttttttttggctttttgttgcaaatttcttttagtttttacctaaaatgaagttatttaagttcctcattccttttaagaattgagatttaaattctacacagcttccatagaagaaagttgaacttaaaaaattagtatcggcccagcacggtggctcatgcctgtaatcccagcactttgggaggctgaggcaggcacatcacttgagcttaggcattcgagacaagcctagcacagtgaaaccccgtctctactggaagtacgaaaattagctggatgtggtggtacatgtttatgatcccagttgatgcagaagaatcacttgaactcaggaggtggaggttgcagtgagtcaagatcgcaccactgcactgggtggcagaacgagacttcgtctcaaaaaaaaaaaaaaaa

SEQ ID NO: 3041 - DNA, 688 bp, Homo sapiens
ccacgcgtccgagagttgggaacgaagtcatgcaagggacagaaagatgctgtcggtagtgagtggatggtcagcagtgggcggaggtgagacgtgagtgagctgaggaggttggctggagcgagatcctgagggtttctcttcgtctccacggcctggtgtaaggggctgcccccgcccccaagtttaaatgctctctagttcacgctctctaagcttcatcatgtcagttctgatcctcattcctggggcgagatcatgtggtgggcccttggtagctcaagattagcctggcagtgtctcatgtccatgtgccatgctgggggcatccaatttattgcaagtgctttggagagcaatttggcattgtttagtgaagctgaagacgcttaaaccccatggctcggtggtcctctctctgcatgtgtgtgtatgttccagaaaaccatcctgacatgcatgtgcagccttgtaactgtggttcgttatattgttggtaatggaaaaatattaggcacaataggagcctggatggctacctcatggctgtttatataatggagtgtatgcagcagtaagatgaatgtatgaggttgaaccatatggtgtggtttcacctaacactagagcaatatatgctgagtggagaaatctgaatgtatagctgagaggaaaaaaaaaaaaaaaa

SEQ ID NO: 3042 - DNA, 1940 bp, Homo sapiens
cccacgcgtccgacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatcaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttagttcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataaaaaaaaaaaaaaaaaaaaaaaaaaa

SEQ ID NO: 3043 - DNA, 1526 bp, Homo sapiens
aattcccgggtgtgtgtctgtgtctgtctgtgtctcgcatggcgcgcggccccggacaagcgctggggattyccgtttraggcgtcactactgtcactgccatcaccccacggagccmcttctagaggggagtagacccggcccttcgccgggcagagaagatgttgcccctgtccatcaaagacgatgaatacaaaccacccaakttcaatttgttcggcaagatctcgggctggtttaggtctatactgtccgacaagacttcccggaacctgtttttcttcctgtgcctgaacctctctttcgcttttgtggaactactctacggcatctggrgcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggkttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgtkggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggartgagacagctctacgtacagattgactttgcagccatgtagtgaatggaaagaaattatgcaccttttatggaccaaattttyctgccagtaagaatttcagttgtgggcctccagtcttctggaatgtcttcactgcagctgctggaaatcactgctttcattcccacaaaaccagtattacttttttttaaaaaaaaaaaaaaaaaaaaaaaaaaaaaaaaaaaaaaaaaaaaaaaaaaaaaaaaaaaaaaaaaaaaaaaaaaaagggcggcc

SEQ ID NO: 3044 - DNA, 2576 bp, Homo sapiens
ggcacgaggttttttttttttttttttcacactttttatactgattttatattgaaatgaaaatattttggatagactgggttaaaaaaaaattaagttcacctgcttctttttactttttgaaatgtgactgtcagaaaatttaaagtcacatatgtggctcacactatttctgtgggacagccctgcctctagctaggggctttggtgagaaccagatgagttgatgggtctcctctgggccctgcttccctggctgctgaggtgcaggaactgtgaggggagggcagcctgtcacggtgcccaacacagggcagggctggacaggtacaagtggaacaggcggataagctgggaagggcacagagaaaaggagctcctcgtgacagcactttcccaccttttattattcaacacatggaagggggtggagacacaaggatagggcaatggtgagtttcaataaataagagaaacaggatggacaggcagtgggcccatgcctgcacggccccacataaataaccaggttgctgagccagagtggaagtcagggctgggcctggcagccgcctgcactgcccagaagcactggcaccacagggacacagaaaccactgaggcccaaggtgtgctccagccccaccaagtcttctccctaaagctcctgagatcttggggctggctgggcaggctagggctctgtatcacagtcctgccgggatcaagtctattttttcagtttcattaaaaacagctgggggaggggcaggcacatgcattaagccccttccgtaggcagagccatggatggacagccccatgggggccttgaaggcagaggccctggaagcagcaaaaacggggctggataaagctactaatgggagggatggtagagcccagctccccagtcccccacaacccagcccagaacctacaaagagctgaagaggccctgggtactgagacgtctctccttacttcacagtcagaaaaatggacccagcgatggccacagatgtgcccaagattagaacccagggactcactctcctagcccaggactttctgctaccccttccctttatagacctgctggaagaggagggggacgcacatctgctctagggccctgtacagaggcaagggtgtggctaattaccaaggaatggggccaggggtgacgggcacaggcccctcccctctgccaagcccagcctctgatgatacagagaatcccgtgggctcctaggatccagccagggcaggcacgggggtcggggcatccttcaggggagcaacatggcagcagggccaggggcggggctcagcctgctcctgtacacagtgcccgccggccacctgcctcctcactggggcagacgctcccacctccaggccttggtctttgctgtctcgtctgctgggccattgcttctcggtcctcacagtcccagctgcagctccacctcctccaggaagccttcggaacctcccagggcagggccgcagtgtccttagactagaccgcccctcagatgaccaggttgctctcacttagccggaccacatagcggttctcctcggccttgttctctgctgggggcttcagccactttgtacggcttccgccacttcctagcagggcctgctgctcaggggggaggccaggctgtggggagtcagggagatcaccccacgagggcccagcctccgtgatggtcttcacctcagacaccattgaacttgtccgctgctcaggaattcgagccacgcggaacctgcccacagacaagatggtgatctcgccctgacgccctgccttggccccggccttgggaaccctggtcgggttaggcagaaggctgggaacaggagtagtggcggctacagcctcaggggacagcagcacctcgggccacttcttctggctacagcgggagcagcaggggccagagagcgaggccaggccctgcacggtgtggagatggtggcggtgcgggcagatgtgtggcacgttcgggggcgctggcggcagcttggacacaggcctgtggctcgtctgcaccagctgtttgctgtggtactctttcagcagctcctccagggccgcagcattctctttcttctctgtgatcaagcgcaccaggaccccaatggtgtcctcattggcatcctcagtccggtaggcagggttgattccactgcctccacctccagggccgggcccgacctccttgtgcgccgtgcagtggtagcccttccgcttgaggaggttgcacaccaggatgcccaacagccccatgaggcagaagacagggacgatggcgatgaccgcgtactgggcggctgtctcctctgggccacctgcccgggtgccgttcccaggctgccgtgtctcaccaccgctgctggcccctgctgccacctccacgccacgtcgggcccgccgcccccactcatcacagccatgagtacccagaggtgcccaggaacatggttgacatggaacgcggggaaccccccaaggcccaaaccacccaggccagcagtctccacagagtgtatctcga

SEQ ID NO: 3045 - DNA, 6705 bp, Homo sapiens
  misc_feature (405)..(405): n equals a,t,g, or c
  misc_feature (2722)..(2722): n equals a,t,g, or c
gaattcggcacgagcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccrctcgggctgtccggcggcggctgcctccgcccgygtgtccgtcaagggtgccgcgggatgtgtgtcagtttacgcctctgagatcacacagctgcctgggggncgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactaygtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccckgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagncycttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagcagccaggagagcaagttgctgtgggtcatccgtgagaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacattttttttyctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggcyttgaatgctaaaaagaagcagggtacgsagggctacatgtagataccacaccaaggctggaggctgstctgtcrtaagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagaaaaaaaaaaaaaaaaaaaaaaaaaaaaaaaaaaaaaaagggcggccgc

SEQ ID NO: 3046 - DNA, 1415 bp, Homo sapiens
acgcgtccgcccacgcgtccgcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccctgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccagagaaagatggggttgttttccaaagtttaagttctagatcacaatatcttagcttttaccactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttaaaaaaaaaaaaaaaaaaaaaaaaaa

SEQ ID NO: 3047 - DNA, 925 bp, Homo sapiens
ccacgcgtccgccagagtcctggccctgagcgggaatcgcagtggccgaggctgagcggcaggtagaaggggcgtctccggggcttcacagggaacacaggggcttcggcccaaccacaagcggatcgccccgaccctcactcctggcgtctgagtctctggcgtagccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgttagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaaaaaaaaaaaaaaaaaaaaa

SEQ ID NO: 3048 - DNA, 699 bp, Homo sapiens
  misc_feature (683)..(683): n equals a,t,g, or c
tcgacccacgcgtccgctcttggaaaaaaattatgttagtcttctataattatagaaataataaatgttcacaatagaaaaattgggaattttagaaagagtagaaaaagaaatccctataatatccccacccaaaggcagttactattaaatttgggtatatttcctaccagcattttttctcatgcatgcatttcttttttacgtagctgtgatcatgaaaacaagataattcgtgtcctgtgttattcatttgacatattccataagtaagctccattatagaaagtaacttaaaatgatgttgtatgtttgtttttgtttgtttatgttttaataaagcatgtggattacttctataagacgaaagggaaaatgtagatcctatgcacaagtatttatttccctccaaaccccctttttataatatgtattgttgattttatagagtgacctgatcagtacatgtaggggctcaaatcacagctattctttaatacttcgggttacttcattgctattattgtttgttactaatatgtaagatgaggaaaagacaaccttttggtgggtgttgggactgggagggagggcattgaggacagatgaaccaaagctggatatggaaggaaacccaacttcataccaaaaaaaacaaaacaaaaaaaaaaaaaaaaaaaaanaaaaaagggcggccgc

SEQ ID NO: 3049 - DNA, 1236 bp, Homo sapiens
ccacgcgtccgagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgaaaaaaaaaaaaaaagggc

SEQ ID NO: 3050 - DNA, 413 bp, Homo sapiens
ccacgcgtccgaagaaataaaaatgtctgtttacagaggacatgataatatacgtagaaaatccaaaagaattgacaacaaaactcctgaaagtttttttagtccttattagtcaattagcaaggttgaaggatacaaggttaatacacaaaagccaatcacttttctatatggcatcaacaaatgaaactagaagttaaaaacacattgccatttacattagcacctaaaagaatgaatacttatatatatatacacatatatatggacctatatacttatagctataaagctaacaaaacatgcaatatctgtgcaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3051 - DNA, 639 bp, Homo sapiens
ccacgcgtccgaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3052 - DNA, 744 bp, Homo sapiens
  misc_feature (271)..(271): n equals a,t,g, or c
ggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacakcctcyacgctggccttcaccttcacccctgcatcgtcggtgaccctgggaccctccaggcagcgtggcctgtggcaccgtgaggnttgggacccaccgaggcgcagaggcggcccgaatgcagccctggttcaggcccggagagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaaaaaaaaaaaaaaaaaaaaaaaaaaaaaaaaaaaaaaaaaaaaaaagggsggccgctctagaggatccaagcttacgtacgcgtgcatgcgaagtcataactcggctata

SEQ ID NO: 3053 - DNA, 678 bp, Homo sapiens
ggcacgagacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcggaaattctggtggaagaacgtgaagatgattgtccttatctgcgtgattgtttttatcatcatcctcttcattgtgctctttgccactggtgccttctcttaagtaacagggaacctctcccacctgcccttcttttcagggacaaccctccataaatgtgtgccaagagggtctcctttcctgtcttcctctacagagaatgctgctcggtcctcctacccctcttcccgaggccctgctgccacgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctaaaaaaaaaaaaaaaaaaaaaa

SEQ ID NO: 3054 - DNA, 2785 bp, Homo sapiens
gataaagaagaaagtaggtgggttacatgaaagcagttatacatcaaaaatatggttttcttcatcttcttttcctccttttcctttctcttcatcgtatctcttcagccacattcacccttaacacaaaaagttcctcctgaaatcctcatgctattttcttggctcaaatccctttgattaccccagattttttggaagaaatccttccaaaggtatttttcatctcaaaaagtttttttgcattcattaccttacttcatgccctcttctttcaaagttccagagagcactgcattcactttgctgcattaagagggaaatagcgtcttctctcctcctatcctgttattgactctcttgtggcttctttcttcatcagagaagcaagtggctcaaccagggcttagaaaaggcacagtgatcaagtctgttcagagccagcctctggctggtgaacatccttgtacttcctgtcctgatctcactcacccctaakgaggcagagagaagggtaaccagtgtggctatcttggctcatcctcgtgggtacaatcaatagctgaggcatgggcttggttgtagagaaacaagtggggccagaggagaggggagaaaggagggaggggagaaagattcccccattggaaattctgctgggattcagtatcctagctattctgatgtcctagatttgaatctgggtttctaaacatatgctctacattatgaaaatgcccaaaaacacatataaattggcttttcttctgtgtttgtcctacattgcagttctataactattttattaagctctctagaactggttcttatatttaccaacactggttattaggttttgaaactcaaaataagaaccatttgtaggcatctgtataaaacaaaatacttattgatcatctactaagcattataccaggctttataacttcctcattcttcttctaagtgttcagtgacttgtggctatttctctaattaaattgaaactcctggtgagaaactttaaggctctccaacaagcaatgtatgttccctcactgtaacttctgtcccagccatacaaactccttctcagttcaccttctctcaagtccaggctttcttcagtgttacttgtgtacctaaaatatgcctatagttcacctcacctccatcctacgtcctatcactgatacaaggggaaatatatatatataatacataaagtcttccttatgatgacttcaaaagaccaagggagggtgkatgggttttttttcttacctcaatattcaaatccctgaggttgkcacaaacaatatcaaatcatgattaaataatgatttaattttcttttgtaagttcttaaaattagkatattaatgataatctgcttgaaatcaagccttattgctcttcccatggaattcgaatgatgmcaatwaattataaacccatcackgtattttcttcattctgtamcatgtcaagatcagcttaatwaattctctgggctacatttgaagtttcttggttaaaaatcagagatccaatgtatcttaaagttaaatttttagatatctaaaaaacatagcatactgcatctgtaaaaatggcatgctgaactttcacaaattattcagaaacaaattttatttagagaaatttaagctaaaaatgcagcaaaccagaaatcagttactgaatgcttcacaatccccagaaaatgagaattatgtaagaaaggaataaaggcaaattttacattgaccctcacagagcaaaattacaggagttctgttctctttgattactaactcagaaataatttatttcaagcttttagcactgaagatgttagttcaaaaaccacatgtttattcttatgcctgtgttgataaaactttgctaaatattttatatgtattaaaaatggagaatgaaagagatgtgtttcaagagccttttacmgataaaycctaacaatcaaataggaaatrgamcattaatgtgaataaaatgctctggcaaggtaggaagaaatgaataactggaagtagagagtccttagcattacaaagtggtaagatttctaaaacagtcatcttgtgagttttttatgcactgttaatagtaacaatacgttccatgaattatgcagttgggatgatttctccttgtgtggattgccagttctagaaatcagtaaaagtgaagaatgagttgaaaaacctatcagcctactgaatctactaaagcctctaaaatattcaatgtctaattgcagcaatttgtatttcataggtgccatatcaaaatcttctccattgaggtcatgattgagtctttaaaaaaaaatttccagatgtgaagatatatatatatacattttaagtttccagcattgtgtgtacaagaaaccaaaacctccatggagggcatgctgatgagttgcatggcacaattgtcatttctgttttgattgcatgtcctatttttgaacctgtaaaagtgtgtagtgcatatatgtgtgtcctatatatggcaatttgtctgatagtgtgtttgagtyctttctggctctttttctagcagagttcaatccacagctttcttcattggagaatttgtgaaataaaagtgagttaatttgtgttacacactctcttaaataacctagacctacaaattgcttgcctaaggctaaaaaatagaaaattcaaagaaacatatgaatgatctcagttggcctttgatgagtaaaaaaaaaaaaaaaaaaactcga

SEQ ID NO: 3055 - DNA, 2163 bp, Homo sapiens
aatggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaactttttcagaagttctgcttaaggacaaaataaagcctaaatccaagaacacttttaaaaatgaggaaatagtgaacacaatagacggaagtctggaagtttctacccatgccaagaaaagcattttatgttttgttcacatatgttgtgcaattcaaatttttttccctatattctctgactagacacttgtactgagtcaattggcgagtgtgtctgtctaaaagcacaatatcaaaatatcacttaaagcatctttacatagtgtgtttaagaaaaagttgttattcagcagaaaggtaattccaattggtctgcatatttatcagcacttggtattgtctgtttcttattttagccattctgataggtgtgtactgatatctaatcatggctttaatttgaatttccctaatggctgatggtgaacatcttttcatgtgcatttctgtcatctgtatgtctttggtgaagagtcttcaaatcttttgttcatcttaaaattggattgttatattaccattgggtttaagaatctacatattatggatacaaatatgttgtcagatatgtgttttgcagcattttctcccagtctgtagctkgyctttaaaaaaaaaattttttttyttttttttttttagagatgggatcttgctacgttggccaggctggtctcgaactcctggcctgaagtgatccttctgccttggcctcccaaaatgctgagattgtaggcatgagccgccatgcctagcccagcttgtctttttgtttacttaccagtgtttttcagagaacaaaaattttaatttgatgaagtccaattaattaaatttttaaaatagagtgtgatttttttgtcatgtctaagaaactattgtctagtcctaggtcctaattctcctttgttttcttctaaatgttttattattttacatgttaacgtttagatttatgatctattttaagttttttttaagtatgaggtttatgttttttgtttgtgtttaggagcatatggatggatgtctagttgttccagcaccatttgttggaaagacyatcctttctctgctgaatttcttttatatcyttgycaggaattagccatattggtatgggtctatttctagactttttattktctcccattgatctgtacatctctccttttgccaataccacataagtcaagatgactatagctttgtaataagtattaaaatctggtaatataaaaaaaaaaaa

SEQ ID NO: 3056 - DNA, 1278 bp, Homo sapiens
  misc_feature (23)..(23): n equals a,t,g, or c
  misc_feature (86)..(86): n equals a,t,g, or c
  misc_feature (1128)..(1128): n equals a,t,g, or c
  misc_feature (1168)..(1168): n equals a,t,g, or c
  misc_feature (1194)..(1194): n equals a,t,g, or c
  misc_feature (1220)..(1220): n equals a,t,g, or c
  misc_feature (1225)..(1225): n equals a,t,g, or c
ttttttttttggggggccccaancccccaaaatcaacgggactttccaaaatgtcgtaacaactccgccccattgacgcaaatggncggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcgggacggataacaatttcacacaggaaacagctatgaccactaggcttttgcaaaaagctatttaggtgacactatagaaggtacgcctgcaggtaccggtccggaattcccgggtcgacccacgcgtccggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaatgattggcattaaaaaaaaaaaaaaaaagggcggccgtctagaggatccctcgaggggcccaagcttacgccgtgcatgcgacgtcatagctctcttcctataagtgaagtcgnattataaagctaggcactggcccgtcgtttacaacgtcgngactgggagatctgctagcttggganctttgggaaggaaccttactttctgnggggngacataattggacaaaactacctaccggagatttaaaggctctaagggaaaat

SEQ ID NO: 3057 - DNA, 1649 bp, Homo sapiens
  misc_feature (648)..(648): n equals a,t,g, or c
gcggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctggnaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccrgtgattgggttcaaaaataaagctggtctgcctcttctcaaaaaaaaaaaaaaaaaaaaaaaaaaaaaaaaaaaaagggcggccgc

SEQ ID NO: 3058 - DNA, 1727 bp, Homo sapiens
agaaaactgtgttgtgcttttggagaacagattctccatctgtatccgaaggacttggtaatggaagcaggctggctgttgaccctgtccattcctggggcacattcacaaccccaaggacaagccgtgtccttggtagaggggggtggtaggtgaaatttttaagtctagccctccagcgctctcccacaagggggcggcagtctaccctcttcacataaagaactgcgtatgaaatgcagcctgctacagggtaaaaggcagcacctgggaagacctgaattgtacttccctccttgccgtgatttgctgcctgttactgcccctcatcamtgtcttgttctatccagcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaaaaaaaaaaaaaaaaaaaaagggcggccgc

SEQ ID NO: 3059 - DNA, 2314 bp, Homo sapiens
acccacgcgtccgggatttctctgtattataaaattagtatataggttgcatagttgattcatgtgcataatttatagtttaaaagtaaagtggtcagtacatatggcttagctctatgtgttagtttttaaaaaaatctacattgttttgagtgtttggttattaatagtttatggatataactgctgcacagtagtaactccttcatctactggaaggaaggtcaatttttcagtcattagaaataggtagctaaatgagatgcttcttatttttgcttggaggtgccaggtttatttgccaactttccacagttagaaagcactttggatcaccactgtcagatatttagatttctttttgagtctggaggattgtatttcttatcaaaacaaatatccaagtttatgctttaaaaatatttaagtttttattaattgcagaatatgagaataaaggaacgaccaaatgctgtaccatattgcctgactcactctgccactaaatggagccccacttgatcctcacctggctttctagattatttatttcctgtatattcccctacattttagtcatatctaacaacttactgggtttttttttttttttttggaaaattttgtaccctttctggcttctccactctatgcttttctcaccactttaaatgtccattttccatatgtcactgttcaatctcagtgcattaaaataatctttatcctttaaggccctgctcaagtactatacaaaaaaatacaaataaacctctttcttctgcttctttaagccgttagtacttattgagtcttgttgtagttatcttagcttcctctctggagcataagcttctggaaggtgtgaatcatgtcctgtacagatctgtgttttctgtagggcctaggaccattcttgtcagaacttgccatttaaagaatggcagatgactgcttcccagagactacacttgacaggaggtctaggcaggtcctagcagtaagggaatgcccagaacaattgagctgttggtttcaggaaaggctaggatgaatgccaggcacacgttctgcaaggcccacagaacatggtatgaaggaggtcttattgtttgaaataggtaaaggtctaatctgtgaatggtcactgtcaggatattcagggatctagtctgagatgcttggttttgtatctgaattctgaattccaaggtctgaaagatctcagagtggggtgagataggaatcaggactaggaaaaacgagtgtgtcagacatgaacttggtgtgagtggggaggagtgtgtggagaccagacagagactagtttggcaattaagtctaagttagaggctcgagcaacagggaataaagtgagagataagtcctggagttaagatatgatattaaaacatgacaggcagttagattaaattgacttgaagctgatttgctaagctgttgactgagtatacttaaatttcctttccttagagcccagttcattcctagttctaggtaaagtcgtttggctttctgtaaaggggtaggaacctttttattccttaaaggtatgactatctatttgccaattaattccatgttccaaggatcccctcatggagaaaatgttgcactgagttaaataaggaaataactggacgaatacttgagattattcccttcataagaataattactaattgtgaattgatggtttgaataccatgctaaaatgattgaacctcttttctcttgtgaagtgattgtgaagttacttgtacctttatgtttttaaaatttgatgataatagcaataaaagctttagtgcttttatgatctctttatttggtttgtagttatggcacatcagaaactcgcatcaaaatagaatcaagattattgtaaaagggacctcaaacgtagatttcttaaaaaaaaaatgttttttattttcaagatggaatcttgctgtgttgctcaggctggtctcaaactcttggcctcaagctgtcctcctcaccttagcctcctgtagtcccagcactttgggaggctgaggtgggtggatcacgaggtcaggagttcgagaccagcctgaccaacatggtgaaaccccatctctactaaaaatacaaaaattagctgggcatggtggcgcactcctgtaatcccagctactccagaggctgaggcaggagaatcgctggaacccaggaagtggaggttacagtgagctgagattgtgcaactgcactccagcctgggcgacagagcaagactccgtctgaaaaaaaaaaaaaaaaaaaaaaa

SEQ ID NO: 3060 - DNA, 1161 bp, Homo sapiens
  misc_feature (1)..(1): n equals a,t,g, or c
  misc_feature (899)..(899): n equals a,t,g, or c
nggccccccccgggtcgacccacgcgtccggttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggcmacgtgtgggcmagtcagccactacaagatttttgctaagctttgggctgttggcagcatcttggncctcatgcctgggcctgaatgaggctctttcttaagtgtttttacaagtttgtgttttatttatggagtgacttatcccttccattcagagcagccccacccagccaccatgctgacgggtatttttcctcataaagtttataaccagttatttatatgaatctttgttatgtccatttgtttgtattgcgtattttgattataaaataaagtatcttaacagacaaaaaaaaaaaaaaaaaaaaaaaaaaagggcggccgc

SEQ ID NO: 3061 - DNA, 1462 bp, Homo sapiens
ccacgcgtccggcggcggcggcggcggcagcgccaggagctgctacagcagaggcggaggttgctcctgtacgcgtacgggccgctcggccggagccgcagcccggaggcgccgggcggtgcgctgggagctgctggtgctgctgctgctgctgctgcccaccctccgccgcccgggcccccgctgccgcccgggccccggctgccgtctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgcgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagtgaagccaaaaattatctaagcagtatccttaaccatgggaggctctcggtaagtcgtcagccttcaagcctgagacctcctctcctcgtctgtcttgcctcgcatctgtccagtcctccctgagtcatttggtcacctgagcaacaagtctctcttacaagctgcccttgcacttacagtagccactggctgcacatggccccttgagcacttggagtatggctagtccacattgagatgtgctgtaagtataaagcatacacaaggtttcaaagacttagtacaaaacaaagaatagaaaagagcagtaactttttatgttgattacatgttcagatggtatattttggatatattgggttaaataaaacatgttattaaaattaatttcaccttttacctttttcagtgtgactaaaaaaaatcttagtagaaatttttaaattacacatgtggttcacatttgtggcttacatcatatttttttggacagtgcttggttgacttaatatgtgcctggccctttgggctccttgggtcagggggctctcaggaaaataaaacctcagtgaacctgtgacctagttagaaacaggcaaacatgcagagttggctagggacagaagagctccataacagggcaagcccatttaagtccacgtgtatttatcaagcacctactgagtacaagacactgagggaggtagaggacccacctctccctcccagaaggagtatggtcacaactttctctggactttgctgctcaaaatgtggtccacccaccagcagtgtaggcatcattggggagctggttagaaatgcaattaagagaaaaaaaaaaaaaaa

SEQ ID NO: 3062 - DNA, 2393 bp, Homo sapiens
ccacgcgtccgatcagaatatttatgcctgatggttaattttagacatctacttgactggattgagagacacacatagctggtgaaacacaatttctgggcatatctgtgaaggtgtttctggaagacactgagataaccctgacccagtgtggatgggcactgatatggtttgcctgtgtccccacccagatctcatcttgaaattgtagttcctataatccgtacatgtcgtgggagggacccagtgggaggtgattgaatcatggtggttgttactgccattctgttttcatggcagtgagtgagttctcatgatccaatggtttcataaggggctgttcccctttggctcagcacttcttcttgttgctgccatgtgaagaaggacgtctttgtttccccttctgccatgattgtgaggcctctgcagccacgtggaactgtcagcccatttaacctctttgctctttataaattgctcagactcaggtatttcttcacagctgtataaaaatggatgaatacacggcaccatccaattggttgagagcccagatagaataacaaggaagaggaaaggtgaattatctcctgaaattgaaacatccttcttctcctgcccttgacatgagaatcagtgtctcacagctttggcctcagaatcagaggtacaccattggcttccctgattctgagtcctttatatctggagtgagtcatgctgccagctttcctggttctccaacttggagacaggctattgtgtaacttctcagcctccataattatgtgaaccaattcccctaatgagtcttctctcatctatctacatatatcctattgattctgcctttctggagaaccctgactaatgttattacaataatacaaaattcactagtttatatagaagacttggtttttgtctttgccccattttgtatttgtattataactgtgtatctggaaaatggaacaagtttttatcttcttcatatgagggccaaagcttttttctcaccaatatttttggagatttttaagattttcttttgtttggacatacaatcttatggaggctgagaaataaaattttttctattttatttttcagccccagatgtttgcttttgcagattcttgagcacattgagagcatggagagcactccaaggcatggagtggggtgcctaaagtttcagtgattacagggagttgagagactcaactgggaaaggaaaagtctaaaaggaggcaatttggaagataaaaattttctcaaaggagcgattaaatttctaaataattcttagtaaaatcatgtaaacaggaaaggaaatagaattaagttccatattggtggaacacatagcagaggtttgagaagggagaatttagtcaactgagaagttctcatgaaaggagcaagtgaagatcacagagacaccttgaaacaaaaagccaggaataacttccaacccaagaggagaacagagaggcctcaaaaccaaagctaggataagaaacttgtagcccaagagttatcttccagacaaagaagcctgagattccaacgcagcttcagagagtactcactcaaaatgttactgaaactgaaggctttttaatgacttagccatgcatgcaaaaggcattccctaaggtggcacagaagacggagcccccatatccaaagatagccaaggagaaagaaagacccctgttgccagagccagtgggcaaaggcaacagaaaaggagacaagggtcctaatgggatgagatcctttcggatttaggcttttatacaaactcctgagaactggcagggtgacagccataaatggggtaccaacatttctactcattggattacaagttctcaggcatccaaaatgatgaacaaaatggacaatttctagggcttctgtgggaaagtatggaaaggtctttttgaaccttttaatgctgtcaacggaagaatgatgaggttcataaatttggaaaggagacatttcttcatttttatgtttatttttatttttttttgagacagagtttcactcttggtgcccattgcacaccagcccgggtgacagagcgagaccctgtctcaaaaaaaaaaaaaaaatgggagaccaaggcgggcagatcacaaggtcaggagtttgagaccagcctggccaatgtggtgaaaccccgtctctactaaaaatacaaaaattagccgggcatggtggcggtcacctgtagtcccagctactcgggaggctgagtcaggagaatcacttgaacccgggaggcggaagttgcagtgagctgagatcacaccactgcactccagcctgggtgacacagtgagactccatctcaaaaaaaaaaaaaaaaaaaa

SEQ ID NO: 3063 - DNA, 2193 bp, Homo sapiens
aaggtacgcctgcaggtaccggtccggaattcccgggtcgacccacgcgtccgcawagacattgaacagtaccaggttcattggctttgctcaggcttgaagccgagtggagttgctcaggggtggccattagtctggtccttgccgcttcactgcatgccgggcagcttgggtggctatccccatgtgtggttttaacacatgtggaccgatgggcttctgtctcagtagtctgctcgcatggtgtgttgactgtttcttctctctgtgtagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccaragttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatgaaaaaaaaaaaaaaaaagggcgrccgc

SEQ ID NO: 3064 - DNA, 372 bp, Homo sapiens
acgcgtccgcggacgcgtgggcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaataaaaaaaaaaaaaaaaaaaaaaaaaaaaaaa

SEQ ID NO: 3065 - DNA, 2731 bp, Homo sapiens
  misc_feature (579)..(579): n equals a,t,g, or c
  misc_feature (1532)..(1532): n equals a,t,g, or c
  misc_feature (2362)..(2362): n equals a,t,g, or c
gctggggaaggtgcagggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcantgggttcagcgacccctactgcctgctgggcattgagcagggggtargtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccakgacgactttctggggaacgtggttctgaggctgcaggttctgacgctcacgggctgggcatccccgcctgtcaggacctgcgctgccgagaggaccagtggtaccccctggaaccccgcactgagacctacccagaccgaggccagtgccacctccagttccaactcatccataagcggagagccacttcggccagccgctcgcagccsagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctcctgctgacctacggcctctcctcatccggaggttccgctctgtcttccccctctctgtctcggactccccagcccggctgcagtctcttctcagggtcntggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccgraggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaagrmccgggcccgcgagctctcttcaggccagaaggaccaaggccaggcagccaacatgctgtgtgtggtggtgaatgacatggagcagctgcggctggtngatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgc

SEQ ID NO: 3066 - DNA, 2783 bp, Homo sapiens
gacccacgcgtccgcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggcgacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagaaggcaggaaagggggagcaggaccctcccctttaaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattgtgtaagaaccaattcaagaccaggcacggtggcttatgcatgtaatcccagcactttgggaggccgaggtgggtggatcacctgagttcaggagtttgagaccagcctggctaacatggtgaaacctcgtctctactaaaaatacaaaaaattagccaggcgtggtggtgtgcacctgtaatcccagctacttgggaggatggggcaggagaaccgcttgaactgggaggcagaggctgcagtgagctgagatcgcgccattgcactccagcctgggcaacaagagcaaaactccgtctcaaaaaaaaaaaaaagaaccaattcaattctgcatttactgagggcctactatgtgctgtgtgcactgcgtgcactcgatacatgtaaattccctgttctctttccaggcaaacatttattagcactcactatagcggcgagtagatgagtctagatgtttttcattaccacaaacagaaaaacagcttgaactaagccagcgacaacagtaatttagtctgagaatggaataaattattgaattaccagacattagagagggtagggaaggtaggctgaatactaacccccaccccaaagatatccatgtcctaatctctggaacctttgactgttaccttgtatggcaaaagtaaaaataaaaagaaaaaagaaaacaagaaaaaaaaaaaaaaaaaaaaaaaaaaaa

SEQ ID NO: 3067 - DNA, 625 bp, Homo sapiens
  misc_feature (623)..(623): n equals a,t,g, or c
ggaacttctgagctccagtgatcctcccaactcagcctcctgagtcgctaggaccacaggctatcatttgctttctgtcaggaaatacacagggcagatcacatcacttttcattggaatgctcatctgcaggcacttgatgttgtgtatcagtgttttctgtctgctgatgactctcctgttccccttcgttcttgtagttttgtatatktkactcaccttcagatcatcttggcagtattgctttctccacttcatttgggatctttccttatttctaattgatcatgtttgccactgttgacagtggcagatccgcatgcgttatttatttcaagaaccctatcccacttctctgcatgcctgcatatattagcctcataaatcaccaagaaaataaagatcttaatgtactctttcaactagctgttgttcagcaagacaccctaaggagagtgaaaactaaagaacaaactggggtaagatatttgttaaaataatatataacttcatataattgtaaaaagattaatatytagactatatattttttaaaaaccctgtgactcaagttataaaaagacaacccggtagaaaagtraataaaggacttaagcatttcnta

SEQ ID NO: 3068 - DNA, 831 bp, Homo sapiens
acgcgtccggtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtccctggggcaggcgggcaccgtcattcgctgccattggcttctcagatgtatttcaaggactaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaa

SEQ ID NO: 3069 - DNA, 1468 bp, Homo sapiens
  misc_feature (561)..(561): n equals a,t,g, or c
gcttccatatcagaagccttgacttaggagtcagacctgggttcaaagcctagtttcatcatttcttagctatgtgactatggggtgtttacttaacctctctgagatttctttccttgatttataatgtggcatgaacaatacctgccttgcagtgttgcatgtggtgatgtgtcttgcttggagcttcctgtggagtttgctccttcatgggttcattcactcctttttttcattcatttcttcatgtgctgttacatgtacctaggaacatatagcttagtagcttagcagcttagcactaggcgctgggcacaaaagggtggagagggtgtgtgcttagccttttgwggctggtaactctgggcccagagttgaggggaatgatttgactggcgaggcagactctgcttggtcccattgtaaaccagtcatagaagagatgcctgtcctgggtaggggccctctcttccttccggtagtgctctgagcattgcctggatgacaggcctattgagcagtagcctgggacttgggagggaaactagggctggagagcanctctgggaggcattggggagggcgtaggtggatgagtcaccatcctccctcaaggacgtcttgggcaagttgtctggccccattagccagcaaccagggaaatgtagctgcaggaaaatcacctcgtttcctcgggatgttttttcttaggctggtttcctttacaagctgcaattatgttccatcccacgcaattcagtaagtggcacttttcagagaaactgtcttggtgatcatttgggctgctgtgggccagggagttgaggagagaagggagtgagagcttctactgagtttagttggttttgtgtccatgagccatttacaaactttgcacctgattgggctcagttgcagtttcttgtatttccctaccagccaagctgttgaagctgctgagcccggaatgatgttatcactgaggcagatgacaaaccctctagttgctagaaaccaaactgctccccgagctggtgtttccgttttttgtactgactgcttatttgggcttgatatataatggtgaaaacaggaactgtttattttaggtgataagaaaccaacattatgacaagaagatgtcatcttagttactctgttaccagtaccataggccagatactatctagatgcttataaacatcttatctaatccttgtaataataagccccaagctaggttttatatccccattttatggatgggggaactgaggccaataacttcatataacttatccaaggccacaaaactagtaataaacagagtgaaattcaacccaaaaacaaactacaaatccaaatttctttacctctatgctgtctgtacttgctgttactagcaaagttctcttggtgggagttaccccatcccctctccaaaaaaaaaaaaaaaaagggcgrccac

SEQ ID NO: 3070 - DNA, 1411 bp, Homo sapiens
gtttcaatccaaatgttgatttacttattctgacacctcatgtcctcttttagctctgcacttttctgccctttattttttggttcacacttttttctaagtatatgggttcagatggccttttacatgattgaaaactgtaaaggaaaaaggtagtagtcaacagtacaatcatggctttaataaccctttattttatgtgacaccaaaaagaattgaaaaatacaaggattgcaatttttaaattatgacgtaggcagctttgaatacatttatgtgttttccctatcaaatgaaaatataaccatatattgtatatatatatatatccttaaaaattggtttttcttacttgaatgttaatttttaaaaatttataatggcattgattaatgttgatgtgatttattgaatctaattcatgtaaaaatgatatattgtgaactgtgatactttcattatcacatcctgtgacatacatggtagttatatgttgaatgttgttgactgacttttattgactaggttactaaattttatctgaatttcatcttaactytgtggcctttatatctcctaagacatctttatatacactttgaaagattaaagaatgtggaaaatatagttgaataaaataactatgatggtgggataattttactaatgcaaataaaatttattcgaagttaatctagaaaaaagttagtgtttatctagggtctattccagtcttccagaagagttctttgtctggttaacacaactgctgtcccactgcctactagggttaattaggttgaccagcctggctagtgagtatctgcttcttccatttctgcttgtggtttctcctttactcattgtgtatttggtgaagagggcagcttcccatatggagggggaccttcagtctaggcgatacyggaarttcagcttccactaatacataaattctggtttcattgacctaatataataaagttaaatccacatatctgggtaaatatctttttcctcgtgccgaattcggcacgaggtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaatttgaaaaaaaaaaaaaaaaaaactcgcggcacgag

SEQ ID NO: 3071 - DNA, 875 bp, Homo sapiens
  misc_feature (521)..(521): n equals a,t,g, or c
tcgagttttttttttttttttttaaatgaaaaactaacttgggaaatacattctttgatggggctagccacacatatgttttacaatacttggtctgcaatgctgtcttttgggtctgagtttcttctcaggagggtatctttgggccagcaataacaatcattgttcagttatacaaactttataatttctgaagtaatttcctatacatcatttcacttagtctttacaaaaaccctatagagaaagcagggtaaagtctgaaataataaataataatcagttaatggaaatagagtatctacatcctggaaatgatggctatgttatacactatgctagctctagacattcttgtatgtggatgaaattagcttcaatacaaccatatgaacagattgggtccagaggcagagggaggcacacacagatcatttgacttgcgtgcttcagatgaggaaacacgcatagagggttaagtggcttgcagaagggcaaccaytaggcaggggtagagcagnacttgaaactacacacacccaacaaatagttcccatatgtgcctggccttggggtagggagacagatgcaagaccagtaggcccttcctccaaggagctaccagtcctgcaggagaaagacatccctcattattcaaataatacattttcaaattacaatagcaagaagtgccctagaaaagaaaagagatctggggtttcttccacttgtgtctacagccacaagccctggccccagctccctgctctctctcctctgatgcaggattatacttgcagtctcagacacccaagcaagggttattcttgggaaggggcaaccacacggcttctaatccttctcgtgccgaattc

SEQ ID NO: 3072 - DNA, 1026 bp, Homo sapiens
ctatcagcaaagaggattttgcaaagccacagaacaatgtgtgaccagcagaagcagccacagttccctccatcttgtgtgaaaggttcgggactaggggctgggcagggtascaatggtgcctctgtgaaatgcccagttccatgccagacccaaactgtctgtgtgacrggccctgctccatgccctactcaaacttatgtgaagtaccaagttccatgccagactcaaacctacgtgaagtgcccagctccctgccagaggacctatgtgaaatacccaacaccctgccaaacctatgtgaagtgcccagctccctgccagacaacctatgtaaaatgcccaactccctgccaaacctacgtgaagtgcccagctccctgccagatgacctacatcaaaagtccagctccctgccagacccagacgtgctatgtccagggtgcttctccttgccagagctattatgttcaagctcctgcaagtggctcaacctcccagtactgtgtcactgacccatgctctgctccctgttccaccagctactgctgtctggctccccggaccttcggggtgagtcccctgagacgctggattcagcggccccagaactgcaacacaggatcatctggctgctgtgagaattcgggaagctctggatgctgtggttctgggggctgtggctgcagctgtggatgtggcagctctgggtgctgctgtttgggaattatccccatgaggtcccgaggtcctgcatgctgtgaccatgaggatgactgctgctgctaaacatacgacagctcaactccagaatgcactgccccgctaccccttctggaacatgcaccagcttctggccccytctctgttagtgccagtgatgtagaacctcatcamtttgcctctgtgstttgyttctctaccaaggcagcctgccagagttagtamagtccccaaamtttggcatgaataaagctctgaatgcatttcgtggtaaaaaaaaaaaaaaaaaaaaagggcggccgc

SEQ ID NO: 3073 - DNA, 596 bp, Homo sapiens
ccacgcgtccgctgtttttcaaagtgggtaatttagtttaatggaatataaccactcattcatccttccatccaacagaggcaagtttggacctgccttgcctttttctgcttttaacatttgtattcaaagttgtacaccattgtcaaatgtataatgtagcagtaaatcattagaggaagtaagttaagtcctgttaatactgttctcaaatataaacatatttctttaatctcttccctatagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacgattaaaaaaaaaaaaaaaaaaaaaaa

SEQ ID NO: 3074 - DNA, 695 bp, Homo sapiens
  misc_feature (6)..(6): n equals a,t,g, or c
acactntccccggcccgcctgccggcccccggtccggcattcccgggtcgacccacgcgtccgcccagggacgtgtctgtgctcctgcgtgtgaccagggttgactaaactcctgccagcatgtcttgccagcaaaaccagcagcagtgccagccccctcccaagtgtcctcccaagtgtaccccaaaatgtccacctaagtgtccccccaaatgcccaccacagtgcccagctccatgtttccctgcagtctcttcttgctgtggtcccagctctgggagctgctgtggtcccagctctgggggctgctgcagctctggggctggtggctgctscctgagccaccacaggccccgtctcttccaccggcgccggcaccagagccccgactgctgtgagagtgaaccttctgggggctctggctgctgccasagctctgggggctgctgctgacctgggctacagaagagctcttgggactgaatggccaagaacctgctacggcctgatggatactctttccacttcctctcattccattcattggttggcagagaccacaaagactcatggggctttcctggaagaacttcgtgcttgatgtaacaccccaattgcaagtcttcttttcctcctttacctcatgttataataaagctctgatctctgactcaaaaaaaaaaaaaaaaaaaaag

SEQ ID NO: 3075 - DNA, 871 bp, Homo sapiens
  misc_feature (555)..(555): n equals a,t,g, or c
  misc_feature (585)..(585): n equals a,t,g, or c
  misc_feature (744)..(744): n equals a,t,g, or c
  misc_feature (837)..(837): n equals a,t,g, or c
  misc_feature (843)..(843): n equals a,t,g, or c
  misc_feature (847)..(847): n equals a,t,g, or c
gaaatacatacctttatatgcatatactatatacatacatatatgcatatacatttagaaataaaaacaccactattctacaaggggagttttattttcaccatttcatagatgcggaaccaatgctccctgatttccaataacttgatctttggatcgtagggtatgaccagcatgttactcctggtccgctggatcccaaagctcttgctccttttattatcctgcatggcccctggatactggggcagaagccttctcttcctgatcttaaaggctggtctgtagaacctgatcatctttcttctaggtaaggagcatcctggagccaaacttcagatacccctggagcattcccttcaccctcaaacctgagctcctcgccccactccagagtgagggtttggccatcacctatggcctgctggaggagtgtggccttaggacggagctggataaccccaggtcaacctgggatgtagaagcaaagatgcccctgtctgccctctatgggactctctcgktgctgcagcarctggctgaggctaagccctncctgatgggcagcagtccagagatgctggncctcgsccagctatgctgtgagtgtccytatgggtgcaagaratagggctgkgcctctctgcgtttccaggtggagtagagacagtaatgggtagagactttaggaaatgttttggggtggtggaatactctatatattgacaagagtttatatattgncaagagtttatatatttgtcaaaactcctcaaatagtatgttaaagacgtaagcgtttcactatgtataaattttacttcaaaataataaaancaaatnctgnctctaaaaaaaaaaaaaaaagggc

SEQ ID NO: 3076 - DNA, 843 bp, Homo sapiens
ccacgcgtccggctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaa

SEQ ID NO: 3077 - DNA, 2973 bp, Homo sapiens
gggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgaraggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacaggcmacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacaaaaaaaaaaaaaaaaaaaaaaaaaaaaaaaaaaaaaaaaaaaaaaaaaaa

SEQ ID NO: 3078 - DNA, 536 bp, Homo sapiens
gatttgaagagggcttgccttccaacctataggcactatatatgcttttggaaaaagtaattaggttaagatgcagttgttttgttttgctttgtttttcccttagctgggttggggtttctagcagcaatgatgtacaggtggatcttttttcacattaacactaccagctgctccatggctatagtgcttaggaatatctcagaatttcaacagatctatcagctgcaatatctaggagtcttgccaacacagagacacattcacatgctgaaaagagcatgagttgaaggcacagctggggacttttgatgcaggtccagaactggatggttgtgaagccattagagatatttaaattgtccagaatttcaggctctgctttaaaaactaggctacaaaccctcattcagaaagaggtcagtaatatgcctgtgagttagaaagatactggaaacatttcaatgccaaaagtaacatttttttccagaatgctatgactaaattttttaaaaaaaaaaaaaaagggcggccgc

SEQ ID NO: 3079 - DNA, 1898 bp, Homo sapiens
  misc_feature (265)..(265): n equals a,t,g, or c
  misc_feature (1854)..(1854): n equals a,t,g, or c
  misc_feature (1859)..(1859): n equals a,t,g, or c
  misc_feature (1888)..(1888): n equals a,t,g, or c
  misc_feature (1897)..(1897): n equals a,t,g, or c
gggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgctggngccaccgtcacgctgaccggcggcttccgcagggcctcatcctgtaccaccagcaccagcacagctrctgtragtcccctacccgcctggcccaacaragccacatggacgcttttragagaagtttctgcattttccgcctaccacaacctccaggggctgctgtggggggatccacgaggccctgcccatcctggaagccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccamgmggcttcagaggaagacatcttcagacacctgggccttgagtaccttcctccagagcagagaaacgcctgagcctgcctgtktcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagtaaaaaaaaaaaaaaaaaaaaagggcggccgctttaaaaggatccttcganggggncccaagcttacgccgggcattgccaacgncataacttnt

SEQ ID NO: 3080 - DNA, 1701 bp, Homo sapiens
gggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaagtgtttgcttatgatcattgtttctggtctatggatgaatctgtcaaagaaaagtatgcaggtcaagatattgttttcaagtgccttggagagaatatcctgcagaatgcttttratggctacaatgcatgtatctttgcctatggacagactggctctggaaaatcttataccatgatgggcacagctgaccaacctggattaatcccaagactttgcagtggactctttgaacgaactcagaaagagggaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaastcagcctggtggatttagmtggcagygaacgagcaacgaagacaggcgctgcaggggacaggctgaaggaagggagcaacattaacaagtccctcacaaccctcggtctggttatctcagctcttgcagatcagagtgctggcaaaagcargaataaatttgttccatatcgtgactcagttctcacttggctgctcaaagacagcctcgggggtaacagcaagmccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaaaaaaaaaaaaaagggcggccgc

SEQ ID NO: 3081 - DNA, 787 bp, Homo sapiens
  misc_feature (7)..(7): n equals a,t,g, or c
  misc_feature (11)..(11): n equals a,t,g, or c
  misc_feature (16)..(16): n equals a,t,g, or c
aacactntcanacggnaacgcttcactatagggtttcgctggwacgcctgcaggtaccggtccggaattcccgggtcgacccacgcgtccggaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacaccacaataatttgggtagtttttagaaaaccttgttagtaaattagaatagtgccactttggcattatgagaaagaagcatggatacataactagggttttgtgtatgactacaacgaaatgcagaatggtgtctccaaaaggtttccagttgctgccacaagaactgcttggtattgcctacatgtgttgtcctatttttgctttgcccttctgcagttacttgctgtgggaccttggagaaattaacttagcctctctgtacttcagttttttgtatttgtaaaaatatatttgtaataatctcatagttaaaaaaaaaaaaaaagggcggccgctctagaggatccaagcttacgtacgcgtgcatgcgacatcatagctcg

SEQ ID NO: 3082 - DNA, 1030 bp, Homo sapiens
aagctggtacgcctgcaggtaccggtccggaattcccgggtcgacccacgcgtccgctcgggagccgcaacctagaagccagaattgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaaaaaaaaaaaaaaaaaaaaaaaaaaaaaaaaaaaaaaaaaaaaaaaaaaaaaaaaaagggcggccgctctagaggatccaagcttacgta

SEQ ID NO: 3083 - DNA, 2770 bp, Homo sapiens
  misc_feature (1570)..(1570): n equals a,t,g, or c
gcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcaggagacccgggcagagaagaarcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcagnttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaaaaaaaaaaaaaaa

SEQ ID NO: 3084 - DNA, 598 bp, Homo sapiens
  misc_feature (597)..(597): n equals a,t,g, or c
aatttcgaataatccggggaaaccccaagagccttactggtcttctgtaacttccaagactgaccagctttttatgtatcagtgtttgataaacacagtccttaactgaaggtaaaccaaagcatcacgttgacattagaccaaatacttttgattcccaactactcgtttgtyctttttctccttttgtgctttcccatagtgagaatttttataaagacttcttgcttctytcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaaaaaaaaaaaaaaaamtcgagggggggcccggtacccaattcgccctatagtgagtcgtattacaattcactggccgtcgttttacaacgtcgtgactggggaaaccctggcgttacccaacttaatcgccttgcagna

SEQ ID NO: 3085 - DNA, 2306 bp, Homo sapiens
  misc_feature (10)..(10): n equals a,t,g, or c
  misc_feature (19)..(19): n equals a,t,g, or c
  misc_feature (39)..(39): n equals a,t,g, or c
  misc_feature (75)..(75): n equals a,t,g, or c
  misc_feature (875)..(875): n equals a,t,g, or c
ccccggagcngaggactgnacccagccaagcgtgcccangcgacacgtcccgtccaacggcccctgtatgatgantgacccctgcttgctgctgaactgaggaccgcaggccgccaccgctcggggcctctggagacttccccctggagcccgccaggccgacactgctgcactcactctgcaagggatcaggaccagcaacctttatattctagattctargacattgtacagagaaatycagaagtgtaaaaatattgcacattgacaaataccaagaatttttgcgtatgtttatattgtattgttctaaataatgggtagcctgtgaaataagawcktgccrcccatgtaataatagtagtaatactakagttaaaatggctgtaagaatagttttataaaagtgaatacacagatctattgtatttgaaacataactttgacaattattagtgtgaccaaagtattaggcggttttcatacattttycaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtatttattgctacatcatagttgataaattgatgttatcgtaaagccatatgttctgttcaagtcttgtttgcttgaaatgattattcctacaagtgaaacactagactatttggagtgtatatggcttgtgttttgggatttttttttttttttttkggctttngttttkgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaartagaaatcaaaatctggcacygaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctyctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaaaaaaaaaraaaaaactcgag

SEQ ID NO: 3086 - DNA, 91 bp, Homo sapiens
aatttatatttttaagagcttatgaatcaagattcggatattttcagatttatgttttctcatgatgtccatgtaatcaggtagataaacc

SEQ ID NO: 3087 - DNA, 699 bp, Homo sapiens
ggcacgaggaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattggcagtcactcgccatttctaagcagatatagtactacctttcagaactcacattggcaagtgtaaaaagatgacttaaggtgaagtgaggacaaaatcacattctgcatactaaccttttttttctccctttaaggtgctaaacttgcacctcatgtccactcagtaacaagtattgggacgtagagcacagcctcactcagctctgaaaggtaatacagcctgtgaggaagtgagccagcagtggcctttgcaattgtggatcttaagctctgctctcagcagatttcaggtgtaaccatttgttaactgtactgaaggtgtgtcctcaagaagaaagtgttcaaattaaaaaagctgctgccaagtaaaaaaaaaaaaaaaaaaaaaaaaaaaaaaaaaa

SEQ ID NO: 3088 - DNA, 338 bp, Homo sapiens
  misc_feature (5)..(5): n equals a,t,g, or c
ggcanaggtccatctgaatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagactttgtttctatatacagttcagccctctgtatcccatggtttctgcatccatggattcaaccaaccaaggctcgaaaatattaaaaaggaaaaaaatccaaccataaaaaaaaaaaaaaaaaaa

SEQ ID NO: 3089 - DNA, 2789 bp, Homo sapiens
  misc_feature (754)..(754): n equals a,t,g, or c
gtgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcaragcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagnctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaaaaaaaaaaaaaaaaaactcgag

SEQ ID NO: 3090 - DNA, 1145 bp, Homo sapiens
  misc_feature (1109)..(1109): n equals a,t,g, or c
  misc_feature (1127)..(1127): n equals a,t,g, or c
  misc_feature (1131)..(1131): n equals a,t,g, or c
ctgcaggaattcggcacgagattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctycagctgactgtgggcgggcccargccagcggcacccttattgcgtggggcartctgtgactgcagtgggccgatatcgccctctctctygggggttgccargaggcagccttgggcccccagctggcctggtagctatgcatttataatgtctctaaacaagcgacactctagtggtgatgggaatagtaaattaaaaagkgagtagatggatttggacaacaaaaaaaaaaaaaaaatnggggccgacatgcttagnggtnatatgcggttaagg

SEQ ID NO: 3091 - DNA, 592 bp, Homo sapiens
cccacgcgtccgcccacgcgtccgggaaaataaaaccaaggcccctttgtcagcatacagcttcagtagataccccaaattcttgaaatctgtatagcagactgctggttttttctccttgtcagagcccagcccactgacactttacagttgacagcccagcccagatatgggccgctgtggcttctatcgaatcatgcttgggattgccacagttttcttctttggattggggcttgaggtggttgggaagaatgcatgccaaccagccctgcatctgggacttggagcctgtcagctccctgctctttgataatggaatagtctgtggacttcttcccatttgtgagagaaaactcccccttagaactcaactggtagagcttctcatagcttacagttccaagcaatagcttggttgtaggtccaggcaggactctgacatggccctctggaatagcattgatgtgttgggttcttcgctaagatgatttccagtctgtgttccagggagattcaggaaagctgaagttcattcttagaacctaggtctgtgtttgttgttttgttttgtttaaaaaaaaaaaaaaaa

SEQ ID NO: 3092 - DNA, 2230 bp, Homo sapiens
ccacgcgtccgctttatatggctgtggggaagagtagccaggaattaatgtatataagcacttaaaagaatgcctgacatacagaaaatactcaatacatgttaactgtaattaatttgaagtggcttcttaaatcaatatttattgtgcatcattttcatcttttaaagataattgctttaatacttgagtatctaattttttttaaacttaagatttttagttagttactgtgttttagactggcaactgtttcagtactttccaaaactgctatctctactgaggtattgtcctgtctcccagtgaaatgtaggctgttcccgttggatggattgacatgggagatttgaaactagttctcctgatttctgagcttatcattgagttcccatgaccaggtgttggtagtgtccacaacagagcaggaagagaaatagtacagaatttcagtggcaagttcttaagccttaacctgtactttaagtccagtccctaaactttcatattccttagtagagaacagatgttcccctttttttcccccacattttccttttttggcttgggggaatagattttttaaaaatctgaatttatattccaaaaaggcatgtgcaagttaattttcctaagtcaatgaagccggtttttaatcttactttgtaagatgcatacctgcagtgagagaagtaggtagggctttagtaatttgtgtcagggaccatgtcctattaaatcctgtgaaaatatgcacatgtagtacacaaagaaaaatttaagggaagaagagttttttccaagttattttataaagtattctttataaaagtatatttcttgtaataatcccccatctgtccttctagcccacctttactttctcacacttatgctctcataacaattaaaatataatcaaagttacttgggtaacttaaaaaattttcattataggaaggaaatgtgttttgaaaatcagaaatttttcaaattttaataaattttagtgttttttatgcaagctgtgagttgaagatgaggggctgggatataaagctaaatcgggtacttatctttattacttatgacctactagggtgtccagagtatgcagagaacatatgggaatttggaagctgggaatggagactggaaaagtgctggattttgaatagtgccaggaaataaaggaagacttagcaagggatcatttttcaatgccagtgacatgctgtgtaatagtctaccatgggaaatttgaatgcttatacgattggtcagtatactaatattgtcttgtaatttgaacactaactcttaatattaacaaattttttttctcaacagccatcgtaggaacttttaaaataggttttgcatttcccctgaaaatggtgagttaggtcatattaggaaaaataaattctagaataaatacaattttgattaaaccggttttctctataaaaacccaagacgctgtatctatctttaatgttatctattgttaaaatttcatttccctcaacagcatgcatttccatgtttattagaccaaacaacttcttgttttacttcttacctttgtttttccttgttgttgttatttaattagaaaagaaatgctgtttgggccttttcatatgcctcaaaaatgtttggttacacagaggagtgagttagatttataggactcacacccaatttgatctcctcaagtgcatttctaaccatgttttcatccacttttccttgttttaggtttctcatagaaacagcttttcattgagctaaatgtatttcctctcttactcgttcttggaaatctaggactatgtatgtgaaacttcttattcttgtacacaataactcttaagtatttgaaaatgactgttctacttcagtcttcttttttgccaaactgagggaaaaaattcttttttttttttttaaaccgcatgcatgtgacatggtttacagacctttccccatctatatcgctctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataaaaaaaaaaaaaaaaaaaaaaaaaaaaaaaaaaaaaaaaaaaaaaaaaa

SEQ ID NO: 3093 - DNA, 1223 bp, Homo sapiens
  misc_feature (13)..(13): n equals a,t,g, or c
  misc_feature (28)..(28): n equals a,t,g, or c
  misc_feature (38)..(38): n equals a,t,g, or c
  misc_feature (116)..(116): n equals a,t,g, or c
ccgattccaaccntccgggacttctaanctaagccccncgggacggaataccaatttccccccaggaaccaagctatgcccactaaggctttgcaaaaaacctattttaggtgccncctatagaaggtacgcctgcaggtacccggtccggaattcccggggtcgacccacggcgtccgattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccgggtttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggctyggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgkttctttgkttttttctttttgtggagagcagggtctggctatgttgcccagctcagtctcaaagtcctgggctcaagcgattctcccgcctcggcttccctaagtgttgggattacagacttgagccactgsatctagccacaactgagttcattattctgagctttctttgggatgktatttaactctcagttcttcttctataagatggaaataatamcaactaaaggctaggatttggggaaggtatggtaaattgkaaaaatggtagcttgtttaaaaaaaaaaaaaaaaaaaaaaagggcggccgc

SEQ ID NO: 3094 - DNA, 1168 bp, Homo sapiens
aattcggcacgagcacagatagaaggagtggtggtatttttaaagtgaactgttgcgatgatatctgcttagctttctcatgctaatctctttctgtggtccatcttttgaaggcctcccttccctgctgggcttccttgcaacacacctaggaattgaaatgtgctcccttttctgtctctctgctgtgctatgtcatcgtcatctccactagttcttggtgcctggcaagaggtggcagccataggatgttttctaaatgaaggagcaaatcaatgaagacgtgccgaggtgcctacatctccacctctggtccgtctcattgcaggctgtaatcgggaggtgaaggagattgaatggaaggcatctaccagcatcagtttggttctgacttgggtttctgccctgttcatggcacagagtccccaccccaaactctagttttagtagatggctatcaattctcttgtgcctaaattcctgccttgtcaaccctagtgcgctgttagccccccaagagaggagcccagcaggttcttgacagcagaatttgtcttgcctgtattttgtccactttatgcatctttgagtccagacctgtcatgagctgtactctttaatctcagacaccttggccatttttcagagtgactaaatagtgcctgctgccaggtccctgttttcaagctccatggcccatcaggaaagaccatgatccctctctgacctcccttgtgatagctgtatgcaatatttctagctgctgcttgtcactgtttggtcaggatgttccctccacttaaccattgctgcccctgaattctttcctaacacttaccccaattcatgggccacctcagggaacatagctagttcaacttcctggcacctgttaaaaagtttcttgagatggagtcttgctgtgttgcccaggctgatctcaaaatcctgggctcaaaggatcctcctgtcccagcctccagaatagctgggattacaggcgcatgccaccgtgcctggcttgcaggcacctttaaccatgcaagcccacagctatcattcttcaatctggtcaagtcattagatacaacaaatgtaatcaaacaaaacacatggaggagaaaataaaataacttactggtataaagaaaaaaaaaaaaaaaaaaaa

SEQ ID NO: 3095 - DNA, 1193 bp, Homo sapiens
ggcacgagggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcttctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggttagcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcattgggggtttgttttggggggtgggagttgatcttcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaaaaaaaaaaaaaaaaaaaaaaaaaaaaaaaaaaaaa

SEQ ID NO: 3096 - DNA, 584 bp, Homo sapiens
ggcacgaggctccttgaggtcgctgtaggcttggtcgcctgaggctggggcagaccttcagggtcagcgaacagcaagatgcaaaggcaccacagacagctcagccatcccactgatggtgggagagacctgcttgctttttcatttgggagttacctgctccctggcctggaggagaagggagaaaacagaaaaaggagtaattcctaacatttgcatagcacaatctcatacaagggatttaatttccttagcaatcctatgttagtaactgtgaagcctcttaaaaaatgaggctctgggaagtcagatgtctggatgaagtttcacagcaaaggcacagtgtagttggactcgggcccatgcccactgcccaagcccctgtacattcctctaggctattgcatggaaggcacaggctcactggcatcggttccaaccagacagactcactcaggcagttccccaatatagggaaggctcgctggcacagaactattggttttgtttttagcagaatttacctgccttttgaatctttgcttaagggcacatttaaaattaagaaaaaaaaaaaaaaaaaa

SEQ ID NO: 3097 - DNA, 896 bp, Homo sapiens
  misc_feature (885)..(886): n equals a,t,g, or c
gaattcggcacgagcattcatcatctcgtagacagcagactctctaagaggaaaggttgtattgcaatacagtaatggggtctttaggcctggktgcaaaggtagaagaagatgatggtgatagtgatggtggtgatggtggtagtgatgatggtgatggtggtggtgatgatggctgtagtgctatatttctgtgctccttccggacccagccattgaaaactctctctccctaaactccctaacatccaatcttccctcaccaatcctggtcctaaaacccctgcttctaatgccttgtaagtgcttggtttctcttggcactggagcaagggagagctgggccctgtctaggggtgtgagatggggacagagcatgggcagggacaaagatggcctctcactgctggtcatagagttgaagtccccctggcaggaggccaggaagggagtggaaggggattctgcaggctccaggacctcctgctttcaaacaggcaggaccacaggtgtgagaggatggggagggagggggaaggggccttgccattgttgcctccctgcctgaaggtcccagggcaagcctcaaacgctggtccttcccagctctgcagctcaacaggtaatctgagacacacctgctaagcccctcgttattgacctcgtgttttgtagggtcacttgactccaacagccatacggttggtaattctaagcctctgagcccctggrcctggcaggatccctcatttttccctttccttcctgctttctaggcccccaccacccacccctktcccccctcccctcaagacacacaccactcagctccacacaacctgctgataaatagcaaaaaagaaaaaaaaaaaaaaaaaaactcgnnggggggtctc

SEQ ID NO: 3098 - DNA, 2878 bp, Homo sapiens
  misc_feature (205)..(205): n equals a,t,g, or c
  misc_feature (213)..(213): n equals a,t,g, or c
  misc_feature (840)..(840): n equals a,t,g, or c
tgatgatcaggatgaagggagcccagtcacccaagaacctgagctagcatcaggtggtggtggtagtggtggagttggcaaaaaggrgcagctgtctgtgaagaagyttcgagtagtactgtttgctctatgctgcamtacagaacaggcagytgaacacttccgaaatccccagcgacgtattcgccgttggcttcgacgtttncaggcctnccagggggagaatctagagggcaaatatctgagctttgaggcagaagagaaactggctgagtrggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcanaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggaaaaaaaaaaaaaaaaaaaaaaaaaaa

SEQ ID NO: 3099 - DNA, 3179 bp, Homo sapiens
  misc_feature (49)..(49): n equals a,t,g, or c
  misc_feature (2993)..(2993): n equals a,t,g, or c
gctctctctctctctctctctctctctgctttcctcgcgagcctgcggntgggcttcttctcagaggaacgagaatgaatatgactcaagcccgggttctggtggctgcagtggtggggttggtggctgtcctgctctacgcctccatccacaagattgaggagggccatctggmtgtgtactwcaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcagcatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccnatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcaaaaaaaaaaaaaaaaaactcgag

SEQ ID NO: 3100 - DNA, 1411 bp, Homo sapiens
ggcacgagctgtaccaaggcttcagagtgagcagggggacatctggataggttagccagggccacagagagaagagctgcttacacctgaattgtttcacccttttcaagaacagggttgtccttctccccatctggatccttgggctagatctctgccgaggggctccgtcaagtcccgcaaggctagagaagggagccccacatcatttccactttcaaagagggaagatgctcgtcattcaaattacttctgttgatttccatggtatccccctgtccgtcccacaatctcttaccaggcgtcaatgcacatgcaggggatggaaagaggatgagccgatgagcagactttgcattaatcaaggagaaagaaaaagcagatggaaggaggtaggtagatggagaaagcaacagctccttttagcccttgatgacggccctgaaggcctgtctcttttagtgactcctctttgggtcctcttcccctacctctcagtgactaggttcctcatattaattccctgctgtgagtttggctccttgtgctgggcaattcagtcatcctcagaaagagcaaagttggtcttggaattaaggtgcaggtggggaaaaagaggactcagctagacacgaagaaaggctctcttcccagtctaagcccttctaccgtaaggggcattttatcaagacagccacccaactccccatcccatctcccctcctttgtagaaacagcatttgactcaccaagcctttctctccctttccgtgtgtcttgcttagtttctggattgagagaatttctatccttgctccctcgaactctaaaagagcttcttttgaaaactggggagtatcaggcctacctctacatgtgcaacagtgccaggattcaaaggaaaagctcattccagcctctgcctcttgggagatggttcagagtgccacatagggactgaaagagggtgtctgaatccttcaggaatgctttaagtgacattgttgaaaagagataaagaaaaggaaaacaatggaattgggtttctaaggtccctggaaatatcctgggggtctaattgagaaagaaaataagaggaaatttgaagactcacttcttccttcatctgaatccactcagatggcaactgatctctgtcccaaggaccctctaccccacccaattcataatcatctcagattagaaaaggcagaattccttcccattctcaaatcagcatttgggttaggggcccctaagttacgtgagcatgttagaaatgtgaccccaggcctcaagagagaggctctgccacatgagaggagataggaatcatgactgaaaggggattagcacagaacagagaaaactgatttgatagacaaatcaaatagaaaaaaaaaaaaaaaaa

SEQ ID NO: 3101 - DNA, 1065 bp, Homo sapiens
ttttttttttttttttttttttttcccaggagtcaacactttattttgttcaggccaaccacactgggagcccagcatccccgcaggataatgcctctgtgggctcatctcgcctcttgagggtggccatgctggctggctctggccaccggggaggcctggccagtctctctgtctccaagttattgtagagtcgggaagtcttcaagggcagcttcaaggaggctgaactggttcctamttctggaggtatttcttcattatgctcgcaacatcgtcgtctttcctccccgtccctggctctctccgctcgggggacgttcgctcgccaccgtcacccgcaagtcgtgggattcctggtcgacttttgatgctgtcagcacttttgaaggacacgatggagccggaggatgaggacgagtcagacaggtgagcgggatcctccttgggctccgggctcttcttcaaaatggtcttgatccccgagagaaaggaacggttagcctcttccgtttcaaagtggatgcttgaacgctgtgaaccgtcttgcccacctttggctgatccagccaaggaggtaggtgtctggggcttccggatagctgggaggaagtcatcgaagtccactttggtcttgcgttcgtagtcgaggcttgggagtttccagctgaatgggtcactgcctagaggttcctccatcaggtgggcaaactggcggttctggaaaacaagcggctcctttccaaggtctggacagcccgcatcgtccacagaggactccagacaccgcctccgaggacgcagtgtgggcgacaacagcatgtccctgggtgtggtcggagagctcagttttctccccatgctcggtctggattctaagagggactcgcaggaactgaatcgggttttcgacttttcggggagtagggttgtgcccccaacaccgtctgaagagatgcatttgaggctggtggacctcaagagaccaccagcggccccttcgatttccaggggtgactttgccccaaccctcagcgagaggtttccctcgtcactgctcgtgcc

SEQ ID NO: 3102 - DNA, 2178 bp, Homo sapiens
agactgtagtctcttgggaccttggtcacttctggcctgccctgcaccgaccagtaactgtgcctgatgactggaggtatggggaattcaccggactttattgttctttgtaggaatcaaagatcaactcccactgaggacaaatggacctgtaattccgggtgtgacgagagaacgtgatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagccttcccagaggccgggcacgcgcagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaataaagcaggaattggtgttgacaatgagctgcatggtttagggagtctttgggagccttggaagtcctgaaggacagacaat

SEQ ID NO: 3103 - DNA, 2469 bp, Homo sapiens
  misc_feature (779)..(779): n equals a,t,g, or c
  misc_feature (788)..(789): n equals a,t,g, or c
  misc_feature (792)..(792): n equals a,t,g, or c
  misc_feature (1020)..(1020): n equals a,t,g, or c
  misc_feature (1022)..(1022): n equals a,t,g, or c
  misc_feature (1027)..(1027): n equals a,t,g, or c
ggcacgagcaggaccggcagccggcaagatgcgaccgccctgcccagcatgtcctcaactttctgggcgttcatgatcctggccagcctgctcatcgcctactgcagtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacgcaagaatcatcaagaccaagcagtggtgtgacatgcttccgtgtctggagggggaaggctgcgacttgttaatcaaccggtcaggctggacgtgcacgcagcccggcgggaggataaagaccaccacggtctcctgacaaacacagcccctgaggggccccgggagtggccttggctccctggatagcccacgtctcagccacagttctccactcgcctcggacttcacccgttctctgccgcccgcccactccgtttccctgtggtccgtgaaggacggcctcaggccttggcatcctgagcttcggtctgtccagccgacccgaggaggcggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccangggactgtnntgnacagaagcggcctcctcccgtgccccagactgtccgaattgcttttattttcttatactttcagtatactccatagaccaaagagcaaaatctatctgaacctgggacgcatcctcactgtcagggtccctggggtcgcttgtgcgggcgggaaggcaatggtggcagaaacatgctggtggccccggcggagcggaaaaggcggccgtggtggaagcctccaccccntnatcancccgcacaccctctgaaggacgggcttcggctgcccggaagccgtggcacacctgcgggaggcagcgacggtccccacgcagaccccgggaacgcatgccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagtatatatttaacagtttttatatgttgtatatttgtagaaaatcctatttaacaattaacgtggcagtcccggccgtcctgagagtcgggccgagccccgtgtgtttctgaagactctgggggtgggacacggcggggaggtggtgccccgcggaccccggggtgccaggcacggaaggcgggactctgggagaagcgtgcggaggaccgtggcgtcggcgttccggatgtgtcggtcgtgcccggggaggccgggttcccctcgctgcgggccaggcttggctcctgattccctctctggtccctgtattggtcaacacttgagcgtacaatatcttgaacatgcttcttccaatgggttttgtttcccatttcctgcccctttcgccactcacggaccttgaggccagttgacggcccttctccccacgcctgtgtccccgcgttctgagaagtcctctgtcttcgtgtcactaggtccagaaagtcgcgccgggcagaggcgcaggcggggccggcagggccgaggaataagcgacaattctggtttttctcccctggccgtcgttcgccagcctccttcattttcctgagttcccgctgaagtatatactacctatgagtccaattaacatgagtattatgctagttctatcatactaaaaaaaacgtaaaaaaataactatatagaagctgttccagcaaccatagactgaagatacgaaagaaaatccatttatttaagacctgttccggtatccatgaggacataatttacctttcagtcaccacaaatttataggcatttgtatcctggactaaaaggagggggctgaggttgggtttgtcatcacagagggggtgggcctggaaagggtccttcccaagctgccccgggctccggcggcccgggccggcagcttctgccagccagcgttcctcacggcctccccctcgcctgtttcttttgaaagcaagtgtagacaccttcgagggcagagatcgggagatttaagatgttacagcatatttttttttcttgttttacagtattcaattttgtgttgattcagctaaattatgaaaaataaagaaaaa

SEQ ID NO: 3104 - DNA, 1464 bp, Homo sapiens
cattttgggaatctcccatgtcaacatcaagctgcgtgcccacgggcaggtagagcgccatcttaatgaggggctccaggtcagggaggcgtggcacagctggtgatcaaaggcgcccgggactcagagcgggagcccagcagggcctgagcagagcctccgctgaactgtggaccccagactccgagcccaccccaaggccgctggcactggtgttcaaaccctcaccacttggagccctggagctgctgtccccccaacccttggttccatatgccgcagacccatagccgcctgcaaggcagagaggacacaggagagccacccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtgggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgctgccctccggggctggtcgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatgggggtggaaaaatcaccgggaatcccccttcagttctttgaaaaagttccatgactcgaatatctgaaatgaagaaaacaaaccgactcacaaaaaaaaaaaaaaaaaaaaaaaaaaaaaaaaaaaaaaaaaaaaaaaaaaaagggcggccgttagaggatccaagcttacgtacgcgtgcatgcgacgtcatagctcttctatagggtcacctaaattcaattcactggccgtcgttttacaacgtcgtgactgggaaaaccctggcgttacccaacttaatcgccttgcagcacatccccctttcgccagctggcgtaatagccaaaaaggcccgaccgaatcggcccttccaaacagttgcccaaccctgaatgggccaaaatggggaacgccgcccttgtaacggg

SEQ ID NO: 3105 - DNA, 1122 bp, Homo sapiens
ggcacgagtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaaaaaaaaaaaaaaaaaaaaaaaaaaaaaaa

SEQ ID NO: 3106 - DNA, 3357 bp, Homo sapiens
caccagcagtagtagcagaagcgaagagcgcaaacgcaaccgctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaatcgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgactatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggataaaggccagggatgctgctcaacctcctaccatgtacaggacgtctccccattacaactacccaatccgaagtgtcaactgtgtcaggactaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagacccttcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacakttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagtgttcaccgcggtga

SEQ ID NO: 3107 - DNA, 2443 bp, Homo sapiens
  misc_feature (41)..(41): n equals a,t,g, or c
  misc_feature (77)..(77): n equals a,t,g, or c
  misc_feature (2326)..(2326): n equals a,t,g, or c
  misc_feature (2348)..(2348): n equals a,t,g, or c
  misc_feature (2375)..(2375): n equals a,t,g, or c
  misc_feature (2434)..(2434): n equals a,t,g, or c
ttatagtcctgtcgggtttcgccacctctgacttgagcgtngatttttgtgatgctcgtcaggggggcggagcctanggaaaaacgccagcaacgcggyctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagcygcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctyccgggcaagaacggcaaccccayttttgctgcartcacggctnggctacgacaagagcccaggtngggaatggctttgcttaaagtttcttncaaacaaaacaggtttyttcmagcagccttkgggwwtttmacagsttctgkttgacagnggtgggttt

SEQ ID NO: 3108 - DNA, 1599 bp, Homo sapiens
tcccgggtcgacccacgcgtccggcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagccccattccttcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaaaaaaaaaaagggcg

SEQ ID NO: 3109 - DNA, 2175 bp, Homo sapiens
acgcgtccgcctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacataattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggacggcctgctatctacagcacagtgtgtcatttgcagatttgtggttacctataccacgctaggtgttttgacatgttttagtgttttctgctttacagtgctgaaattccatatttttagaaagctatgaaagtccttttatgaaaaagttactgattgcttctcagttattaggaaaacagttgtttccccattattatgtagatatgatgccccaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatgttgtgacaaattgatcacttgtgtacgaaaaataaatctccttaaaaactaaataaaatgcactgtattcttaaaaaaaaaaaaaaaaaaaaaaaaaaaaaaaaa

SEQ ID NO: 3110 - DNA, 1603 bp, Homo sapiens
ggcacgagcggcacgagcagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtgtcatcaataaaattgtatgttaatgctggaaagaaaaaaaaaaaaaaaaaaaa

SEQ ID NO: 3111 - DNA, 1177 bp, Homo sapiens
  misc_feature (1071)..(1071): n equals a,t,g, or c
  misc_feature (1164)..(1164): n equals a,t,g, or c
gaattcggcacgaggttcggcgaagatagggaataaggaagcacaggagtaggggagaaggaagcacaggagtaggggagatatacagcggtcaggataagggggaaagggcggtggttgcgcaagaggtgaaacaagatgtgagagacaaggggtagggaagaaatggggcagcggttaggttcagaagcgcatagaccgtggcggacgggcaatgcgaggggcacagaaaggaactgaggggtgggctatttaaggagatggtcctcagccctctcttttctgcgtaggtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttctttctgtcttgaagaatgataggagagatgatggggctctttttggcctgaagaggagaaggaatttattctttcattcagctytgagatcccagagktttctgaggcaragtccctgnctyacccaccagaggatacacacttatgacatgcctcccacacattcatacaaacaagtacctgttcatccaggtggtgtgtgttcagtgggnggcaagacagagc

SEQ ID NO: 3112 - protein, 141 aa, Homo sapiens
LPASGCHGPAASSYSASAEPARVRALVYGHHGDPAKVVELKNLELAAVRGSDVRVKMLAAPINPSDINMIQGNYGLLPELPAVGGNEGVAQVVAVGSNVTGLKPGDWVIPANAGLESRSVAQAGAILAHCNLQPPPHRRMA

SEQ ID NO: 3113 - protein, 6 aa, Homo sapiens
MWPAPS

SEQ ID NO: 3114 - protein, 18 aa, Homo sapiens
LGLLVPLEPHHVLGVESP

SEQ ID NO: 3115 - protein, 78 aa, Homo sapiens [sequence omitted]

SEQ ID NO: 3116 - protein, 25 aa, Homo sapiens
HGLLPVCPWACGLRPPRTTPRKKIS

SEQ ID NO: 3117 - protein, 41 aa, Homo sapiens
MCGRRPRLGWTCVWGCTRAPCWGASWARSAGSTTCGRLMSL

SEQ ID NO: 3118 - protein, 139 aa, Homo sapiens
MSCPAHASPPCSNTSGCLEFSFCGFALPIPSPVLHSSWQGGEGWGWFGWVRGFFLCVRCCYLTVLRPYWPFSSSSYLYGTSNKDTHFRPGKKKKKKKKKKKKKKKKKKKKKKKKKKKKKKKKKKKKKKKKKKKKKKKKK

SEQ ID NO: 3119 - protein, 30 aa, Homo sapiens
MLMMGTLVLILLHDVIVTFTEFYNAQNLKW

SEQ ID NO: 3120 - protein, 20 aa, Homo sapiens
FLLSFCAFPCVFMFWVSVLH

SEQ ID NO: 3121 - protein, 21 aa, Homo sapiens
MIYLSIYLLVNILAVSNSWPS

SEQ ID NO: 3122 - protein, 17 aa, Homo sapiens
MPWCLLPLCLHILCVSA

SEQ ID NO: 3123 - protein, 55 aa, Homo sapiens
MVLAIFQNALSFTISALLFILSFYFGTAALWLFICQNCHFLSIQLLCPLFHESPN

SEQ ID NO: 3124 - protein, 11 aa, Homo sapiens
MHQPLCIYCFS

SEQ ID NO: 3125 - protein, 54 aa, Homo sapiens
MTENPKVQMMLIIVVPLQLFINPVQHPIQQVRCIHLHLCHGWALDRLALELVCL

SEQ ID NO: 3126 - protein, 10 aa, Homo sapiens
MTRCLWRTLQ

SEQ ID NO: 3127 - protein, 13 aa, Homo sapiens
MKTTCLSSTLVRM

SEQ ID NO: 3128 - protein, 38 aa, Homo sapiens
VLLILKLLLLKGARSIQIFMFRCLIAFALITKLQNYMD

SEQ ID NO: 3129 - protein, 94 aa, Homo sapiens
MRTIYSAFFFLSLCLSVLLSSTVFDDWHPISISWVQNFGLTPSFDVQVPQTLRCFFRSGCRWHPLNLLQFKLSTFLRIISFYLSFCSEKRLQHE

SEQ ID NO: 3130 - protein, 359 aa, Homo sapiens
MMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 3131 - protein, 38 aa, Homo sapiens
MRTEVGAQRACAVRCVLALGAVVSLLVPPTPALSSIPS

SEQ ID NO: 3132 - protein, 1167 aa, Homo sapiens
  SITE (429): Xaa equals any amino acid
  SITE (435): Xaa equals any amino acid
  SITE (437): Xaa equals any amino acid
  SITE (444): Xaa equals any amino acid
  SITE (447): Xaa equals any amino acid
  SITE (452): Xaa equals any amino acid
  SITE (588): Xaa equals any amino acid
  SITE (832): Xaa equals any amino acid
VELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAXYLGYSXSXMLLRGGXRLXLSGAXRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTXSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLEXRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 3133 - protein, 23 aa, Homo sapiens
MSVLLLSSSCGAAFAVLCPPHCE

SEQ ID NO: 3134 - protein, 3 aa, Homo sapiens
GYS

SEQ ID NO: 3135 - protein, 68 aa, Homo sapiens [sequence omitted]

SEQ ID NO: 3136 - protein, 42 aa, Homo sapiens
  SITE (38): Xaa equals any amino acid
MLLFWAIFASYVSIQSMHFRCCGREIFGGAGTSKTGIXLKSQ

SEQ ID NO: 3137 - protein, 37 aa, Homo sapiens
MVGNAFLWLFVHLESVYVQLSSAISWAMGNISVKTNF

SEQ ID NO: 3138 - protein, 17 aa, Homo sapiens
MTCFCQIKYRYHWGFLF

SEQ ID NO: 3139 - protein, 42 aa, Homo sapiens [sequence omitted]

SEQ ID NO: 3140 - protein, 19 aa, Homo sapiens
MYAFLQGFIFLLLFFFIAE

SEQ ID NO: 3141 - protein, 124 aa, Homo sapiens [sequence omitted]

SEQ ID NO: 3142 - protein, 29 aa, Homo sapiens
MKSVLSICSFLGCALSAVSKKSLPNQRLQ

SEQ ID NO: 3143 - protein, 29 aa, Homo sapiens
MKSVLSICSFLGCALSAVSKKSLPNQRLQ

SEQ ID NO: 3144 - protein, 2 aa, Homo sapiens
GA

SEQ ID NO: 3145 - protein, 76 aa, Homo sapiens
LVPLLPGPLVRFCFCLHVGVGSSVGGGAPCPGCRPASCARAPFRVGLDHPSPHQGPHCEVITALNPPLLFYLLNLI

SEQ ID NO: 3146 - protein, 58 aa, Homo sapiens
EFFLFSLSFSLLPSCLSFSPFFSLPFPSPPSLPPSLPSFLPSFLVLFCNPGCSAMAKS

SEQ ID NO: 3147 - protein, 203 aa, Homo sapiens
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTCCVAPALHWRAVPTLTATTP

SEQ ID NO: 3148 - protein, 136 aa, Homo sapiens
MAGWGLVDVSGAPEPWRIPHGIPLPALSGLCGVRRSPSSRFSFFPPQQRNWRKDIKLSAVDLSAEIFPESMVVLNYLHVSSIFNSGVGLFLISSQKCSALGEGTSPLACHFPGVLYHFDGTLWSAENALSWHASRL

SEQ ID NO: 3149 - protein, 29 aa, Homo sapiens
MFSCFSLVVFILFSLGFFCNAFVQLILSC

SEQ ID NO: 3150 - protein, 42 aa, Homo sapiens
VKVLWLILFILSCSLAGYWQTQSFCFHKELMKRTIGETHVCL

SEQ ID NO: 3151 - protein, 34 aa, Homo sapiens
MISMCQMLRTTVMTHLWIVTWIQRSWQESGDIRV

SEQ ID NO: 3152 - protein, 23 aa, Homo sapiens
MQSWLWAAVCSAGCPCFWGMKAL

SEQ ID NO: 3153 - protein, 31 aa, Homo sapiens
MLSPFTLLLSYATIVHFCMPLIPFLLILTIK

SEQ ID NO: 3154 - protein, 733 aa, Homo sapiens
MQKPTDNAQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNHDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 3155 - protein, 107 aa, Homo sapiens
MAQQDPGLPFLFWFSVASLITLFHLFLFKLSFGGLQFTENHLQFQADPDVLHNSYALHGIRYKNDHINLAVLADAEGKPYLHVSVESRGQPVKIYACKQAAWTSQWS

SEQ ID NO: 3156 - protein, 8 aa, Homo sapiens
SCFNLLGT

SEQ ID NO: 3157 - protein, 36 aa, Homo sapiens
MNAAVLLTLVFFLLLYLFYLGVLGSDPAYLPLLKKS

SEQ ID NO: 3158 - protein, 8 aa, Homo sapiens
KSILGSHS

SEQ ID NO: 3159 - protein, 77 aa, Homo sapiens
LLITILLGLYFTLLQASEYFESPFTISDGIYGSTFFVATGFHGLHVIIGSTFLTICFIRQLIFHFTSKHHFGFEAAA

SEQ ID NO: 3160 - protein, 31 aa, Homo sapiens
MISMKMILVILVTLALPVAQLHLLLLVLKIQ

SEQ ID NO: 3161 - protein, 4 aa, Homo sapiens
FPYS

SEQ ID NO: 3162 - protein, 28 aa, Homo sapiens
MVFSCHLLFLIRCLYSCGHLSSTLQHII

SEQ ID NO: 3163 - protein, 31 aa, Homo sapiens
MPLVYPVCLLLICFHLSFIEEDPFMILNTFH

SEQ ID NO: 3164 - protein, 89 aa, Homo sapiens
  SITE (34): Xaa equals any amino acid
MVCTYFLPFCNVFLCLLFLWLCRSFFICCNLIFXSLLFLLVLLESYPKNHCPVQSQETFPYIFFSSFIILGLTCKSLIQFELIFVYGVR

SEQ ID NO: 3165 - protein, 94 aa, Homo sapiens
MDIKNITCSMKITWYILVLLVFIFLIILTIRKILEGQRRVQKWQSHRDKPTSVLLRGSDSEKLRALNVQVLSAETTQRLPLDQVQEVLPPIPEL

SEQ ID NO: 3166 - protein, 28 aa, Homo sapiens
MARNVWFFIVSFCYKFLSYFRASSTLKV

SEQ ID NO: 3167 - protein, 9 aa, Homo sapiens
MPLPSSGQF

SEQ ID NO: 3168 - protein, 49 aa, Homo sapiens
MLAWQHFQIAFCLLGSWGFGGRGSISTLHEIAYFIMMELLFLLSCDFFF

SEQ ID NO: 3169 - protein, 68 aa, Homo sapiens
LASGPGATLRCLVWLWSLSLRALLPLSHAVWWVILCPEPPPWTGPVSRAGTPCLFSLFRHNSRSLASH

SEQ ID NO: 3170 - protein, 11 aa, Homo sapiens
MHLHLPTTLVL

SEQ ID NO: 3171 - protein, 29 aa, Homo sapiens
  SITE (27): Xaa equals any amino acid
MEGKLTTSKILIVGKVFWVSCTLFYIXFF

SEQ ID NO: 3172 - protein, 48 aa, Homo sapiens
  SITE (2): Xaa equals any amino acid
MXLQGLPGTSGTGLGCLLCLVLFLSIAVTNKGMEEQSDKKKKKKKKNS

SEQ ID NO: 3173 - protein, 16 aa, Homo sapiens
MALRLARMWLSSLASV

SEQ ID NO: 3174 - protein, 1 aa, Homo sapiens
I

SEQ ID NO: 3175 - protein, 35 aa, Homo sapiens
AHVVVVVLWWEFAAVQTLWPGKSKFLQDGFTASLD

SEQ ID NO: 3176 - protein, 40 aa, Homo sapiens
MLFISNLPLPSQFIYLASDSFFSSPTPFSSTSQPTNTYSL

SEQ ID NO: 3177 - protein, 254 aa, Homo sapiens
  SITE (222): Xaa equals any amino acid
MQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVXAQFLLQFAFQGRHATGAAGGGQMSGCGPSRRW

SEQ ID NO: 3178 - protein, 23 aa, Homo sapiens
VQTYVVLLHFALSCFADIVFFTN

SEQ ID NO: 3179 - protein, 32 aa, Homo sapiens
YLLKISLFLGAVYVTLHSSGSCHVFMSEYFWF

SEQ ID NO: 3180 - protein, 32 aa, Homo sapiens
KAIWFLILCTTHSILIITFIYKKNKENNSKLC

SEQ ID NO: 3181 - protein, 55 aa, Homo sapiens
MTNYFWASASSCTVFPLAFLCSSCVGPPSFSCAHHILHQESWHLFFSSAWNAFLC

SEQ ID NO: 3182 - protein, 55 aa, Homo sapiens
MWALKSLFLLTPSPVIRFYFAALWIRAAGRLLGGGGSPTPPTSLAPGFSEAGGLC

SEQ ID NO: 3183 - protein, 23 aa, Homo sapiens
VGHFWVVIWLVRSMSDRMNKNAL

SEQ ID NO: 3184 - protein, 43 aa, Homo sapiens
MGIFDYKLFSHYFKACFIFFLILLTHLCLSLFYYKLFIVQSLP

SEQ ID NO: 3185 - protein, 265 aa, Homo sapiens
MGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDAGAGCVWGRHVGQVNCQLPGGASGKLWALSSDGKTQEDSQAHNRLFSFCAQHRQQQEAGLRPRLQPAFCTQHLLPSPKSDAATTLRDPAPNAVGAPVTLRKPVPYPWYPRFPRALGTTRKPPRYFSQNRNSYGTK

SEQ ID NO: 3186 - protein, 15 aa, Homo sapiens
MPLPSSPRNCFLKWI

SEQ ID NO: 3187 - protein, 25 aa, Homo sapiens
MALCSLAVFCPSTILGCDLVQLGPE

SEQ ID NO: 3188 - protein, 1 aa, Homo sapiens
I

SEQ ID NO: 3189 - protein, 147 aa, Homo sapiens
VGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 3190 - protein, 80 aa, Homo sapiens
NSLVKFTFPPPLSGAPSCVICGFWTPNVSLAVGLPEVWYVLEQWEAVICCVSSHPALESNGHSQPELPLSTPCLGFCSLG

SEQ ID NO: 3191 - protein, 14 aa, Homo sapiens
MPYMYSSPLPIFYT

SEQ ID NO: 3192 - protein, 31 aa, Homo sapiens
MLMLPLLLLILSVELFQLFLSLKLLPLLLLL

SEQ ID NO: 3193 - protein, 47 aa, Homo sapiens
MRFASSDLLCYWKLALFTAIRSSLASIPLMTSFTSLTPLYYCLAQFS

SEQ ID NO: 3194 - protein, 45 aa, Homo sapiens
  SITE (31): Xaa equals any amino acid
MHVLLFSFLIPFLLLSPVGVTCNSHMLERQXSWLKKRSTQASQHV

SEQ ID NO: 3195 - protein, 1 aa, Homo sapiens
W

SEQ ID NO: 3196 - protein, 38 aa, Homo sapiens
MLLVALPCFLQNCPWSSRVLETLCLLNGPLFLCCALDG

SEQ ID NO: 3197 - protein, 145 aa, Homo sapiens
KSQVFSYPHRYLVLDLALLFLMGILEAVRLYLGTRGNLTEAERPLAASLALTAGTALLSAHFLLWQALVLWADWALSATLLALHGLEAVLQVVAIAAFTRGFGGEVRAKAGDETAGERAAEGHIRSLRPLQFYQLLPFCTELNKF

SEQ ID NO: 3198 - protein, 211 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 3199 - protein, 46 aa, Homo sapiens
MLQTCSVVLHFILCLCVCVFRLIQVVCYISCIIYKVTQNIKSSKLV

SEQ ID NO: 3200 - protein, 122 aa, Homo sapiens [sequence omitted]

SEQ ID NO: 3201 - protein, 29 aa, Homo sapiens
MLCVLVLFILYLPGFSKSNQDVPWGDILC

SEQ ID NO: 3202 - protein, 60 aa, Homo sapiens [sequence omitted]

SEQ ID NO: 3203 - protein, 49 aa, Homo sapiens
  SITE (40): Xaa equals any amino acid
  SITE (48): Xaa equals any amino acid
MKGHSSKLFCLVVWGFLCFLFLGCFFFNCLVQKKKEKKNXGGAPEPNXP

SEQ ID NO: 3204 - protein, 5 aa, Homo sapiens
WASLT

SEQ ID NO: 3205 - protein, 22 aa, Homo sapiens
MTCLSCLISFLASLSANWASTR

SEQ ID NO: 3206 - protein, 11 aa, Homo sapiens
MKPSWQLPSCA

SEQ ID NO: 3207 - protein, 26 aa, Homo sapiens
MKYCFRPWVLCDTTLGIGLFGFALCF

SEQ ID NO: 3208 - protein, 12 aa, Homo sapiens
LLVLLQIMKGNL

SEQ ID NO: 3209 - protein, 55 aa, Homo sapiens
MGGDQRSMGLACESPLAAWSLGITPALVLQMLLGFIGAGPSRAGPLTLPAWLHSP

SEQ ID NO: 3210 - protein, 120 aa, Homo sapiens
MMCVVLTTLPCLTFSIAVTEVQKSINGSADVLPDMLPDLPVSLVLLSLIMVDIIEKLRIYPLRGSQKSKCSFKCEYFLKFDIFFTFLPLCYLTTCLMIPFLRANITDRRLQMKISKHNYF

SEQ ID NO: 3211 - protein, 20 aa, Homo sapiens
MGTIKPWKSSAVVGGPGHQG

SEQ ID NO: 3212 - protein, 425 aa, Homo sapiens
  SITE (264): Xaa equals any amino acid
  SITE (274): Xaa equals any amino acid
  SITE (278): Xaa equals any amino acid
  SITE (296): Xaa equals any amino acid
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQAAXLPAAAPVQQXADPXAARQQHGLLPGPVQHLVXEGDGGPVPPRGRQRDQHHHRQPLGRILLQRPRRSPLPGHEPEPVPVPARRLPEENAFPLPPEPPPELPDDASHSGARAPRSAHRAGPEPQPAVGAAPGSGAGQLPGQPALVQPELQPAPGRPPWPLRQC

SEQ ID NO: 3213 - protein, 52 aa, Homo sapiens
MRLSVRRVLLATGCALVLVLAVQLGQQVLECRAVLAGLRTPGGPCGLSRRSW

SEQ ID NO: 3214 - protein, 7 aa, Homo sapiens
MQVFEFF

SEQ ID NO: 3215 - protein, 73 aa, Homo sapiens [sequence omitted]

SEQ ID NO: 3216 - protein, 23 aa, Homo sapiens
MAFLPSPAWWISLLPSLLSIARS

SEQ ID NO: 3217 - protein, 133 aa, Homo sapiens
MISDAGAGFGVFLLVPRAGHCWGAGKPSLPVLLWPPSPHGCCHPSWREGGESWCEPSGFPPTHPGAGWARTGRGSTAALLALLLPQLGVDRASLSPLFWREGEGGGLQAGARLGVLGGEMRFRGCLMGWAGLG

SEQ ID NO: 3218 - protein, 62 aa, Homo sapiens
MEQEPVRRYPLVPLVPLVVVAVWGFFPGGSESSSSELDSISLRSSLDTLPLETALQAIFTIK

SEQ ID NO: 3219 - protein, 16 aa, Homo sapiens
LFVFFCFVLVFFFFLA

SEQ ID NO: 3220 - protein, 12 aa, Homo sapiens
MLLLSIVLLLIL

SEQ ID NO: 3221 - protein, 38 aa, Homo sapiens
MAHSRYSTIIILYLIANWLAFAQHSAYIGPLRGLSPAS

SEQ ID NO: 3222 - protein, 29 aa, Homo sapiens
MLMASALSRCAGAAVLVLLLWLAVDWALM

SEQ ID NO: 3223 - protein, 41 aa, Homo sapiens
MKLFFCLCAGLILEFQKALWERKRLLNKVWNRAPHSDNMQS

SEQ ID NO: 3224 - protein, 48 aa, Homo sapiens
  SITE (9): Xaa equals any amino acid
  SITE (10): Xaa equals any amino acid
MATQQCIYXXLCWLFIYSLYRRKLNMDHTFSPEFSFSLQVPQNYCVLN

SEQ ID NO: 3225 - protein, 17 aa, Homo sapiens
MSSLLLIIILALSLAYE

SEQ ID NO: 3226 - protein, 33 aa, Homo sapiens
MWMAKPTCYLALTGWSCWRTCWERSGWALYLQP

SEQ ID NO: 3227 - protein, 20 aa, Homo sapiens
MAAMVFLLLSITTIWGAFKK

SEQ ID NO: 3228 - protein, 29 aa, Homo sapiens
APLCHCPYFGFCKHPLRLVSSLGKQASTS

SEQ ID NO: 3229 - protein, 60 aa, Homo sapiens
MGFHLLLGLVNLLGLVNCFLLGKPNYLSLIVSIVAPLTFLFSFISNIKKKKKKGGRSRGS

SEQ ID NO: 3230 - protein, 7 aa, Homo sapiens
MFECYCL

SEQ ID NO: 3231 - protein, 7 aa, Homo sapiens
MFECYCL

SEQ ID NO: 3232 - protein, 52 aa, Homo sapiens
  SITE (18): Xaa equals any amino acid
MSLTTLWTLDKLLLCVCXLICKMKIISVSYRYSLNRDNYTYFKVVKYTITTR

SEQ ID NO: 3233 - protein, 13 aa, Homo sapiens
CTHPASGPLSSTS

SEQ ID NO: 3234 - protein, 39 aa, Homo sapiens
MVMFLSLSLWINPVIGKDMTIWRWNTYRKDQISYLLFFH

SEQ ID NO: 3235 - protein, 42 aa, Homo sapiens
MLLCPNLRNPLIWGLILLTHAISVSVASFYYIILVKSKLYHV

SEQ ID NO: 3236 - protein, 41 aa, Homo sapiens
MPFPWSFRLLMLLSTAQSPQPQKRFPLHSTPLQSNFPLSKC

SEQ ID NO: 3237 - protein, 62 aa, Homo sapiens
EAFCFLRSYFCYSCNAPPYMPHLCESTGIRFGHHTCLKLGSVCSVFCVEWRKKRLPCCLPCS

SEQ ID NO: 3238 - protein, 25 aa, Homo sapiens
  SITE (24): Xaa equals any amino acid
MSPSLLLTCIIGRLIIPPSLKSPXS

SEQ ID NO: 3239 - protein, 46 aa, Homo sapiens
MALLWQINWTIAEAFLRGDITDSTALWSWAATSRTSLWSTVTSPAL

SEQ ID NO: 3240 - protein, 226 aa, Homo sapiens
  SITE (10): Xaa equals any amino acid
  SITE (31): Xaa equals any amino acid
  SITE (32): Xaa equals any amino acid
  SITE (37): Xaa equals any amino acid
  SITE (129): Xaa equals any amino acid
  SITE (130): Xaa equals any amino acid
  SITE (150): Xaa equals any amino acid
  SITE (214): Xaa equals any amino acid
MRGLLCWPVXLLLLQPWETQLQLTGPRCHTXXLDLVXVIDSSRSVRPFEFETMRQFLMGLLRGLNVGPNATRVGVIQYSSQVQSVFPLRAFSRREDMERAIRDLVPLAQGTMTGLAIQYAMNVAFSVAXXARPPEERVPRVAVIVTDGRXQDRVAEVAAQARARGIEIYAVGVQRADVGSLRAMASPPLDEHVFLVESFDLIQEFGLQFQSRLXGPGPLQWRGPWL

SEQ ID NO: 3241 - protein, 33 aa, Homo sapiens
MRAGIVCILYIFICSVFAQCLVHSRVSMYECVG

SEQ ID NO: 3242 - protein, 47 aa, Homo sapiens
MIFPKICPISPNLVSVLSLVFFWTLLGSRRVCYQFSRLGEVRSGEQL

SEQ ID NO: 3243 - protein, 47 aa, Homo sapiens; identical to SEQ ID NO: 3242

SEQ ID NO: 3244 - protein, 43 aa, Homo sapiens
MFTIRSRMCLHFLVLVICILRECESVCVCVCVCVCLWHLGRVV

SEQ ID NO: 3245 - protein, 43 aa, Homo sapiens; identical to SEQ ID NO: 3244

SEQ ID NO: 3246 - protein, 471 aa, Homo sapiens
  SITE (37): Xaa equals any amino acid
  SITE (41): Xaa equals any amino acid
  SITE (43): Xaa equals any amino acid
  SITE (48): Xaa equals any amino acid
  SITE (191): Xaa equals any amino acid
  SITE (373): Xaa equals any amino acid
  SITE (446): Xaa equals any amino acid
STPSGYLELPDLGQPYSSAVYSLEEQYLGLALDVDRXKKDXEXEEDQXPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYXLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKXRRRGRKEGEEDQNPPCPRLNGVLMEVEEPEVLQDSLDRCYSTPSMYFELPDSFQHYRSVFYSFEEQHISFALXVDNRFFTLTVTSLHLVFQMGVIFPQ

SEQ ID NO: 3247 - protein, 43 aa, Homo sapiens; identical to SEQ ID NO: 3244

SEQ ID NO: 3248 - protein, 43 aa, Homo sapiens; identical to SEQ ID NO: 3244

SEQ ID NO: 3249 - protein, 24 aa, Homo sapiens
MLFFPLVLLPCVFLSYSKRRRAQG

SEQ ID NO: 3250 - protein, 187 aa, Homo sapiens [sequence omitted]

SEQ ID NO: 3251 - protein, 235 aa, Homo sapiens
  SITE (204): Xaa equals any amino acid
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCRASSTSGAHVDSARLQMHWELWSRQRGRPQGGDDLPGVLGQPTYHQQPDREGWAGPPAAETMPQAACQLLLPAEPDIGLVLVPGCKQRQCPAQRPHSGAPRRVXQGTHHRAGWQPCLHCGHHLQDAGLDPRGPRW

SEQ ID NO: 3252 - protein, 78 aa, Homo sapiens
DLGTLRTARRWLRGVQGPFPPGSSCLHPALSCGPSSHSEALQNMSPVGTSSFPVPGPQLVSAAASLGPFPKPRVTAGA

SEQ ID NO: 3253 - protein, 9 aa, Homo sapiens
MASGSKISS

SEQ ID NO: 3254 - protein, 69 aa, Homo sapiens
MVPTPPGWVGFFVFWVFLGGGLFHVTSISVFISYLFHFQVYHGKCTDFFVNNVLGFAKKEKKKTLLSLP

SEQ ID NO: 3255 - protein, 118 aa, Homo sapiens
MPFTFSWCFSLWTLLNHRPDKSLQRKGLWAVPEAGWGQDNTAASPGCPLWGPLGAGKGIGQRGSGAGHEGPPSALWLQGWRWFCPPSLPSGGAGGSAAGVGTSPRMAVEGVRTVLGSP

SEQ ID NO: 3256 - protein, 36 aa, Homo sapiens
MFLLTIGKIEKALCFLFFCCCCHCCFFQKTSVSVLS

SEQ ID NO: 3257 - protein, 41 aa, Homo sapiens
DFLFFFPPCGSHCFLSCLYLSLCLSSSFPQMSQLSLPNFPI

SEQ ID NO: 3258 - protein, 29 aa, Homo sapiens
MRQQQTHLAAGVLFCCRLTFSSSVSGKSG

SEQ ID NO: 3259 - protein, 42 aa, Homo sapiens
MMNVSLEIYFVVFLSLFCVVLPLHALFLKSFFFLDFACFQIL

SEQ ID NO: 3260 - protein, 34 aa, Homo sapiens
MQCNFLSSLERWGHIPLGCFLLCVILISLAGKQK

SEQ ID NO: 3261 - protein, 20 aa, Homo sapiens
MTTFLLLLLLVSIFSSVNCG

SEQ ID NO: 3262 - protein, 17 aa, Homo sapiens
MRIASFCWEDRIFHSKF

SEQ ID NO: 3263 - protein, 22 aa, Homo sapiens
MVIFIILLTCFGFSNGSFSFSL

SEQ ID NO: 3264 - protein, 22 aa, Homo sapiens
MVIFIILLTCFGFSNGSFSFSL

SEQ ID NO: 3265 - protein, 10 aa, Homo sapiens
MVVVTLMLFL

SEQ ID NO: 3266 - protein, 51 aa, Homo sapiens
LEAPSMKTDTRTIFVAIFSCISILLLFLSVFIIYRCSQHGELRERKGREGE

SEQ ID NO: 3267 - protein, 15 aa, Homo sapiens
LPCLAGCRVKFMIMK

SEQ ID NO: 3268 - protein, 32 aa, Homo sapiens
MEKGAAKKNFWVQGTVYLLLLFMPVAGCPTTL

SEQ ID NO: 3269 - protein, 50 aa, Homo sapiens
MSLSVAWWLSVCSAAGEGPTPGQCSAFRRPTGNQKFPNIMAPSPLQSSFP

SEQ ID NO: 3270 - protein, 40 aa, Homo sapiens
MKNPITKRWKHLTGTLILVNSLDVLRAAAFSPADQDDFVI

SEQ ID NO: 3271 - protein, 22 aa, Homo sapiens
MVPSLNLYLLVSWDTLLENFLM

SEQ ID NO: 3272 - protein, 66 aa, Homo sapiens
FYLLVLVFLNSIFAELSLFLPCLSPVCLSFVVDIVLSSPKYLSLETYSKRILFSMSVFLLCCPPCL

SEQ ID NO: 3273 - protein, 2 aa, Homo sapiens
DI

SEQ ID NO: 3274 - protein, 42 aa, Homo sapiens
FLPTLLIIISLFQFGLFFSFNESNRIHGSFYFNVFILSGQCI

SEQ ID NO: 3275 - protein, 15 aa, Homo sapiens
MFEDNKWWCILFLIR

SEQ ID NO: 3276 - protein, 18 aa, Homo sapiens
MKTVSPKCLRITLSTSCP

SEQ ID NO: 3277 - protein, 40 aa, Homo sapiens
MRCARHWKWLLLCFWGQLICRRLWRRSGRGKCFLCCLHRE

SEQ ID NO: 3278 - protein, 31 aa, Homo sapiens
MASVFLLLYLELFCQPFPSTLGACKSRGALF

SEQ ID NO: 3279 - protein, 51 aa, Homo sapiens
MAFQSLLEMKFFLCAAFPLGAGVKMFHYLGPGKPLPQASPSPHPHRNRIWP

SEQ ID NO: 3280 - protein, 82 aa, Homo sapiens [sequence omitted]

SEQ ID NO: 3281 - protein, 43 aa, Homo sapiens
MEIYVSLGIVGLAILALLAVTSIPSVSDSLTWREFHYIQVNNI

SEQ ID NO: 3282 - protein, 42 aa, Homo sapiens
MLLVSCCLAGHICVWDAQTGDCLTRIPRPGRQRRGQWRGQRA

SEQ ID NO: 3283 - protein, 55 aa, Homo sapiens
MSMSCPWLGTWAVVCASPRQRNDSQGTDARGGNRADQRLPGHKRNLEERTPAEQT

SEQ ID NO: 3284 - protein, 44 aa, Homo sapiens
MWVLLSLFCIFVLLLILFAFIAKTHIRLTMSQALFSVLHRYEFI

SEQ ID NO: 3285 - protein, 35 aa, Homo sapiens
  SITE (5): Xaa equals any amino acid
  SITE (6): Xaa equals any amino acid
  SITE (7): Xaa equals any amino acid
MFLLXXXSSLCPFSPSFSLSSLPFYLWCYHVLEQQ

SEQ ID NO: 3286 - protein, 25 aa, Homo sapiens
MCRYLPLMLFMTMCRFLLGLFAVGW

SEQ ID NO: 3287 - protein, 45 aa, Homo sapiens
MMVTRLPCWAGVLPPVPLLLACMTSTARPWAQAPCPFSTAPLSRQ

SEQ ID NO: 3288 - protein, 30 aa, Homo sapiens
MAVGSCSPILSLLGPGILAPLSALPLISVP

SEQ ID NO: 3289 - protein, 10 aa, Homo sapiens
MWQVAPVHLL

SEQ ID NO: 3290 - protein, 5 aa, Homo sapiens
NNRYV

SEQ ID NO: 3291 - protein, 39 aa, Homo sapiens
MEAVYHYFLLLLLEIFSEYLILHFLLSFAIEFFIPMITS

SEQ ID NO: 3292 - protein, 36 aa, Homo sapiens
ERCVFWLFRPPAFPSLSLLPAPASLFRDTKISKLVQ

SEQ ID NO: 3293 - protein, 65 aa, Homo sapiens
MLHTMRNVRGCVCVCVCVCVCVSEGHLLNGTPKNTIVFVFAVVRGLNKCKLAQEMLDLRGLERPD

SEQ ID NO: 3294 - protein, 26 aa, Homo sapiens
MFFLLLLMLLPHCLNYYILLTNLTFW

SEQ ID NO: 3295 - protein, 6 aa, Homo sapiens
MLLPLL

SEQ ID NO: 3296 - protein, 19 aa, Homo sapiens
MLPPLLEWAVFVPLSQLLL

SEQ ID NO: 3297 - protein, 39 aa, Homo sapiens
MFFLIKVPLNWPLYQPLVLAKCPKHALGPRHVTIHRLSV

SEQ ID NO: 3298 - protein, 48 aa, Homo sapiens
INSWKRPVNASCFCICVLRWALWFLCTQSTFLVITIVIFIVMTAPELW

SEQ ID NO: 3299 - protein, 52 aa, Homo sapiens
TFGLFLLFLAIVNSAVMNTDVQFFGVNICFYSFGYIPRCGIAGSYMVILSLT

SEQ ID NO: 3300 - protein, 9 aa, Homo sapiens
ALWLLLQLS

SEQ ID NO: 3301 - protein, 9 aa, Homo sapiens
ALWLLLQLS

SEQ ID NO: 3302 - protein, 9 aa, Homo sapiens
ALWLLLQLS

SEQ ID NO: 3303 - protein, 3 aa, Homo sapiens
GRW

SEQ ID NO: 3304 - protein, 36 aa, Homo sapiens
MVLALAVFTLLASVCCQLHSHSFYPCMSCFYSSLSF

SEQ ID NO: 3305 - protein, 64 aa, Homo sapiens
MWLLWQPYLAGFLLQVLEGRVAQSQAEADSGVLGAGGTTPAGGRRGLCQQSEQPRGPIPHILQV

SEQ ID NO: 3306 - protein, 41 aa, Homo sapiens
MLSGSSRGSQGSLNLHVCLWLPPQPPLHPSYSFSFFLQFWE

SEQ ID NO: 3307 - protein, 223 aa, Homo sapiens
MWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 3308 - protein, 47 aa, Homo sapiens
MTLTAWTGACWPSFTWLMPRTSWRMLLLLFWTSSMIWLPRECGSFST

SEQ ID NO: 3309 - protein, 24 aa, Homo sapiens
MGELLWLVILCAHIIVATHHCWEN

SEQ ID NO: 3310 - protein, 8 aa, Homo sapiens
MFQRLLKY

SEQ ID NO: 3311 - protein, 27 aa, Homo sapiens
GVSVIISLLISSSEDCYQSLGLEVQII

SEQ ID NO: 3312 - protein, 38 aa, Homo sapiens
MRVVLPSWLGSSGCWDILSLLCFNIFTALFLNGPVTRD

SEQ ID NO: 3313 - protein, 5 aa, Homo sapiens
FCELA

SEQ ID NO: 3314 - protein, 55 aa, Homo sapiens
MSACLPGSLFLLFPPAGRYQRRGHPSRPGMGRKEVTAKAVEWGWHQPLVCFPCGS

SEQ ID NO: 3315 - protein, 24 aa, Homo sapiens
MSIWLMHFCLLVLGKRMSILDVKL

SEQ ID NO: 3316 - protein, 32 aa, Homo sapiens
APRFPSLLVLLPGILFPGLSGHCFVSGFFTLL

SEQ ID NO: 3317 - protein, 6 aa, Homo sapiens
MYFWCC

SEQ ID NO: 3318 - protein, 327 aa, Homo sapiens
MLATSQALDTVWRMAKGFVMLAVSFLVAAICYFRRLHLYSGHKLKWWIGYLQRKFKRNLSVEAEVDLLSYCAREWKGETPRNKLMRKAYEELFWRHHIKCVRQVRRDNYDALRSVLFQIFSQGISFPSWMKEKDIVKLPEKLLFSQGCNWIQQYSFGPEKYTGSNVFGKLRKYVELLKTQWTEFNGIRDYHKRGSMCNTLFSDAILEYKLYEALKFIMLYQVTEVYEQMKTKKVIPSLFRLLFSRETSSDPLSFMMNHLNSVGDTCGLEQIDMFILGYSLEVKIKVFRLFKFNSRDFEVCYPEEPLRDWPEISLLTENDRHYHIPVF

SEQ ID NO: 3319 - protein, 327 aa, Homo sapiens; identical to SEQ ID NO: 3318

SEQ ID NO: 3320 - protein, 56 aa, Homo sapiens
MWPFYLRRVVVQSSLGPMKLPCSLWLWTVVASCICCPHGGVFLCGSCSCCVSGLLL

SEQ ID NO: 3321 - protein, 5 aa, Homo sapiens
MGHTP

SEQ ID NO: 3322 - protein, 9 aa, Homo sapiens
LKILFLIEV

SEQ ID NO: 3323 - protein, 27 aa, Homo sapiens
MTSSVACPGARVCLAGSWPAASSSPCW

SEQ ID NO: 3324 - protein, 34 aa, Homo sapiens
FGYFWYRWPLGWIFLHSVPQLQEGVPLVCEYVCL

SEQ ID NO: 3325 - protein, 18 aa, Homo sapiens
LATLLLRLLLSLGTGCQR

SEQ ID NO: 3326 - protein, 43 aa, Homo sapiens
  SITE (28): Xaa equals any amino acid
  SITE (33): Xaa equals any amino acid
DQFSTAVRHRVPAGHWQVAGSTPTPCPXNPDLXPGKEREGPVS

SEQ ID NO: 3327 - protein, 117 aa, Homo sapiens
CVETPRPGFCQKAPWYQPGKSATKPTTTREETIPSKFTSPNTNLPKLNRLQPLCPDPTLTAFPFTQIWAFWQKVLRLWGKRRAVMALRWVSYSPEEIGLFYALPYIRNYIQDAILRH

SEQ ID NO: 3328 - protein, 281 aa, Homo sapiens
MAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 3329 - protein, 50 aa, Homo sapiens
MHLCLLWQLHYVVGDVDAEPHILSSCLCYSPLCFTFSNECQAGDFQIQKF

SEQ ID NO: 3330 - protein, 50 aa, Homo sapiens
MVYIYYLYFLTFYYLLNPLHQTTTYGTSQGSSLGALFFKYSVLMKNKFNI

SEQ ID NO: 3331 - protein, 36 aa, Homo sapiens
  SITE (35): Xaa equals any amino acid
MFDSTPVLVALFLHPRLGASYSLCLQHSSSPCLPXS

SEQ ID NO: 3332 - protein, 36 aa, Homo sapiens
MELWLPRYLKGLSCLLLFDLFNLIWAIKYHFSGLFF

SEQ ID NO: 3333 - protein, 11 aa, Homo sapiens
MSHSLSVACVY

SEQ ID NO: 3334 - protein, 4 aa, Homo sapiens
LDFC

SEQ ID NO: 3335 - protein, 10 aa, Homo sapiens
MCGAFQDSPQ

SEQ ID NO: 3336 - protein, 41 aa, Homo sapiens
MYNHLSLNCTLPLFICALFLVYSVIIPHLKNKNHYCYILLI

SEQ ID NO: 3337 - protein, 46 aa, Homo sapiens
MMAIPYFILAELNFIFLCILLPDDLGGKSRLVKANHGSSILMILLG

SEQ ID NO: 3338 - protein, 348 aa, Homo sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 3339 - protein, 66 aa, Homo sapiens
  SITE (40): Xaa equals any amino acid
MCLLSLAYFILVLGYGASYGKGKGPFRKTSFGEIKMWTVXKKKKKKKKKKKKKKKKKKKKKKKKKK

SEQ ID NO: 3340 - protein, 14 aa, Homo sapiens
MLSQPPHSKRGYRL

SEQ ID NO: 3341 - protein, 34 aa, Homo sapiens
MFLSFLNILIILLQGIWEPYLVFACNVIRYNYTM

SEQ ID NO: 3342 - protein, 127 aa, Homo sapiens
MVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 3343 - protein, 2 aa, Homo sapiens
PC

SEQ ID NO: 3344 - protein, 72 aa, Homo sapiens [sequence omitted]

SEQ ID NO: 3345 - protein, 17 aa, Homo sapiens
MCTSVLLAIFLLCFSVT

SEQ ID NO: 3346 - protein, 21 aa, Homo sapiens
MRAGCRLCSLWLWTHNSWARG

SEQ ID NO: 3347 - protein, 10 aa, Homo sapiens
MLALSTHFLP

SEQ ID NO: 3348 - protein, 49 aa, Homo sapiens
MWAGASRGRTGARLAVPLHAWCTLWPLALGQAILLQIPVLPQGHHQAPP

SEQ ID NO: 3349 - protein, 28 aa, Homo sapiens [sequence omitted]

SEQ ID NO: 3350 - protein, 12 aa, Homo sapiens
MVCLLVHSFLSF

SEQ ID NO: 3351 - protein, 182 aa, Homo sapiens
  SITE (1): Xaa equals any amino acid
  SITE (5): Xaa equals any amino acid
  SITE (11): Xaa equals any amino acid
XLLPXTPLGIXYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKAEQSEDKPEKYELSVIM

SEQ ID NO: 3352 - protein, 52 aa, Homo sapiens
MKWVLTCTTLEVVCLACDKHAADVMLAFIIIGYLPYPRMSSCPLSPLIIDRS

SEQ ID NO: 3353 - protein, 30 aa, Homo sapiens
MAKFTSWFLVFFVLVAHSLHILPHPVCLGS

SEQ ID NO: 3354 - protein, 57 aa, Homo sapiens
MNSQVLYFTVLVCLMEISRWSHKNILCSVPSKRTIYFSSLIVPQSHIWWWSAKSHLV

SEQ ID NO: 3355 - protein, 57 aa, Homo sapiens; identical to SEQ ID NO: 3354

SEQ ID NO: 3356 - protein, 32 aa, Homo sapiens
MFHVCCAFLNFMLHSKTVVLFLWCLDSCGVCF

SEQ ID NO: 3357 - protein, 50 aa, Homo sapiens
MYPLDVDNNVPFLSLFLLLLLKLIVLPNLLLCFFPNTVIYLICRQEPCLC

SEQ ID NO: 3358 - protein, 43 aa, Homo sapiens
MKAISVSLLRLTKLLWFFSIVLYVPLLAVLLFNTVLYFFSKCT

SEQ ID NO: 3359 - protein, 35 aa, Homo sapiens
MAFLILHGVQMTTILLLVAQMTALSFGFGMYKQEN

SEQ ID NO: 3360 - protein, 23 aa, Homo sapiens
YVCVYVVCCYLHGKIWHHQQKIY

SEQ ID NO: 3361 - protein, 43 aa, Homo sapiens
  SITE (14): Xaa equals any amino acid
MCNQVFLLLILILXDDHFYTLWQSLIASVSCLENEFIIYLLGN

SEQ ID NO: 3362 - protein, 14 aa, Homo sapiens
MRKLAFGLRISYCS

SEQ ID NO: 3363 - protein, 73 aa, Homo sapiens [sequence omitted]

SEQ ID NO: 3364 - protein, 42 aa, Homo sapiens
MSKFVSLPVFLACISPWFNSYQIFGRGGTEVSSHSRALGCPY

SEQ ID NO: 3365 - protein, 450 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVISYEMLHVTPPMSPPDVLKTSPVADAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLRGYWGGPAFLRKLFHLGMS

SEQ ID NO: 3366 - protein, 35 aa, Homo sapiens
MTTRRSPTDILLLLSESSWTMRRLKAYLKVSLIPK

SEQ ID NO: 3367 - protein, 450 aa, Homo sapiens; identical to SEQ ID NO: 3365

SEQ ID NO: 3368 - protein, 35 aa, Homo sapiens; identical to SEQ ID NO: 3366

SEQ ID NO: 3369 - protein, 35 aa, Homo sapiens; identical to SEQ ID NO: 3366

SEQ ID NO: 3370 - protein, 48 aa, Homo sapiens
MCPPHLMLICLMVMPRVQDLVTCAVVNTQRLGRSVSLVLPSFKVHGKI

SEQ ID NO: 3371 - protein, 26 aa, Homo sapiens
MVFFSAILFLYILYLFADYSSIFDFP

SEQ ID NO: 3372 - protein, 8 aa, Homo sapiens
MAKFTVLW

SEQ ID NO: 3373 - protein, 34 aa, Homo sapiens
MVHLLLVFWSGPHNLGRFQPMKLFAICLNQSMLL

SEQ ID NO: 3374 - protein, 33 aa, Homo sapiens
MLHGVVIVRLWLLLGRNSLKRNSLVWRGSRSPK

SEQ ID NO: 3375 - protein, 17 aa, Homo sapiens
LWVWLRSCWKNSTCPAW

SEQ ID NO: 3376 - protein, 93 aa, Homo sapiens
MWIRVGFLVFKTPGLRTPAAGERIYNISGNGSPLADSKEIFLTVPVGGGESLRLLASDLQRHSIAQLDPEALGNIKKLSNRLAQICSSIRTHK

SEQ ID NO: 3377 - protein, 31 aa, Homo sapiens
MYNLSSLFMISFLVCHVTPSQTLKGPPLSWS

SEQ ID NO: 3378 - protein, 6 aa, Homo sapiens
MFLREQ

SEQ ID NO: 3379 - protein, 32 aa, Homo sapiens
TSCCIIIFLCAEQLKTQPQYANCFNAILRQLI

SEQ ID NO: 3380 - protein, 30 aa, Homo sapiens
MKTWLPKRSLLLCTPTTCRPAASPTLTCRS

SEQ ID NO: 3381 - protein, 10 aa, Homo sapiens
MLLYLTVGYW

SEQ ID NO: 3382 - protein, 27 aa, Homo sapiens
MTVPTLAMKKNQDAASWSLTCVSCLHY

SEQ ID NO: 3383 - protein, 35 aa, Homo sapiens
MKFKSQCLEIKFYSHTACSFVYLLCMATFTLQWQS

SEQ ID NO: 3384 - protein, 381 aa, Homo sapiens
MSRHEGVSCDACLKGNFRGRRYKCLICYDYDLCASCYESGATTTRHTTDHPMQCILTRVDFDLYYGGEAFSVEQPQSFTCPYCGKMGYTETSLQEHVTSEHAETSTEVICPICAALPGGDPNHVTDDFAAHLTLEHRAPRDLDESSGVRHVRRMFHPGRGLGGPRARRSNMHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 3385 - protein, 93 aa, Homo sapiens [sequence omitted]

SEQ ID NO: 3386 - protein, 113 aa, Homo sapiens
MSPSPRWGFLCVLFTAVHPAPSTAPVQDKCPVNTWEAMQASSQQLLQTDPRPKPFLLPPLPPLLLISAGTEVSSLVFQKSPLHTQPEGAIKTAGQPTSVHSKVLSKGSLLLGE

SEQ ID NO: 3387 - protein, 35 aa, Homo sapiens
HKKSFQGRALGDPLFKGIWAGFIVVSSEESGKGRP

SEQ ID NO: 3388 - protein, 48 aa, Homo sapiens
MIGKKKGTLEEIVLMIVVLVSTQCLIMTMEVVLKNLVIMTEWIMKMTD

SEQ ID NO: 3389 - protein, 30 aa, Homo sapiens
MAMGAASSGWSAPASSSWSTLWWSSFPRPR

SEQ ID NO: 3390 - protein, 227 aa, Homo sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEWQQGPAAVVRHGSLGTAPGQVAKNSRPVRGHRHRPCLLPHGAVGHPGVQPPQAEGLPLHGAQRVGPGPGVEAVESTLPTGLRMPMRTPLGSWCA

SEQ ID NO: 3391 - protein, 40 aa, Homo sapiens
MNIYTILKILPHRMLWPFIYLIIATYLFFISSSTHSKGYS

SEQ ID NO: 3392 - protein, 25 aa, Homo sapiens
MLISVMLHSLWLVIHLGPQHTVILF

SEQ ID NO: 3393 - protein, 397 aa, Homo sapiens
MDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLNRNLKCKHNIWKICCLPSTSQIFLVKVSNFFTET

SEQ ID NO: 3394 - protein, 38 aa, Homo sapiens
MFLCCQIGPLGPFRFCFLGAGFLPWTPSLGTVDIKCLA

SEQ ID NO: 3395 - protein, 23 aa, Homo sapiens
MGWSSHWSNFLSVRLWFSTLAIC

SEQ ID NO: 3396 - protein, 34 aa, Homo sapiens
MFYWGGLSFYFLLSSGVGFYCFLFGFGMEIWIAA

SEQ ID NO: 3397 - protein, 58 aa, Homo sapiens
  SITE (54): Xaa equals any amino acid
MYMPAPPLSLAPAVGETFPVCRERMWSWQAWLLPDSVSSGNTQPSFKKKKTRSXPSDR

SEQ ID NO: 3398 - protein, 33 aa, Homo sapiens
MCVCMHVCVCCVWWEAAWGCQKRAEGGIRPSWT

SEQ ID NO: 3399 - protein, 32 aa, Homo sapiens
MLIITPKLKKVGSQPQMEDWAPLLPSSASLLP

SEQ ID NO: 3400 - protein, 43 aa, Homo sapiens
ELRCLVCFFAFQRHFLAERYNGALQETLCPQHLFCSLADRSWP

SEQ ID NO: 3401 - protein, 30 aa, Homo sapiens
MENCLYVVALMVLMPSVVWKCMIQLEMNGR

SEQ ID NO: 3402 - protein, 32 aa, Homo sapiens
MLRGFFVVLFCLIMNGCWILSHARSASIGMIM

SEQ ID NO: 3403 - protein, 114 aa, Homo sapiens
DRERNMATCAQLLRLVLEAEHIAPAAWHWPWDMGGRGRRVPAYVGRWAGAQTQQAPWGHSSPLHPFILKHLQRASSARLSGAKGTEMRTDSPLGETVFAWSCPQCKAQEWCRGA

SEQ ID NO: 3404 - protein, 46 aa, Homo sapiens
EVIGLLLLLLLLCNNNRQKQRRGESADAWPLPWGFPSAEESVAAQL

SEQ ID NO: 3405 - protein, 59 aa, Homo sapiens
  SITE (34): Xaa equals any amino acid
CPSVSACCLGLPIWIVGKSKRAWCLPTPPDSSRXKPRPHEACPTRSPMAQTAPPPSHKV

SEQ ID NO: 3406 - protein, 243 aa, Homo sapiens
  SITE (146): Xaa equals any amino acid
MLVIQITSVDFHGIPLSVPQSLTRRQCTCRGWKEDEPMSRLCINQGERKSRWKEVGRWRKQQLLLALDDGPEGLSLLVTPLWVLFPYLSVTRFLILIPCCEFGSLCWAIQSSSERAKLVLELRCRWGKRGTQLDTKKGSLPSLSPXTVRGILSRQPPNSPSHLPSFVETAFDSPSLSLPFRVSCLVSGLREFLSLLPRTLKELLLKTGEYQAYLYMCNSARIQRKSSFQPLPLGRWFRVPHRD

SEQ ID NO: 3407 - protein, 17 aa, Homo sapiens
LLLLLFMLSLGKPLGRT

SEQ ID NO: 3408 - protein, 44 aa, Homo sapiens
PARLLPPGPAVALLLLRGSCSLCCCHQPHKASCKAMPSAGSNVP

SEQ ID NO: 3409 - protein, 22 aa, Homo sapiens
GSLLSQILHMACDHPRGLTVGA

SEQ ID NO: 3410 - protein, 32 aa, Homo sapiens
MAPAPCSASPRPAGGRDGGGAPELSFLLSVLV

SEQ ID NO: 3411 - protein, 68 aa, Homo sapiens
MLLLFLLNLLPVPQALPALSWPWVFVIAIPLLGSTVLPDLCKAGSLFSFSFALMPLPQSCHCATPVKA

SEQ ID NO: 3412 - protein, 9 aa, Homo sapiens
VFYCYGLII

SEQ ID NO: 3413 - protein, 8 aa, Homo sapiens
HRAVILAL

SEQ ID NO: 3414 - protein, 73 aa, Homo sapiens
  SITE (52): Xaa equals any amino acid
MALSNSVAPKPSPPWPLLGCFLHSPSHFLVCCILHTFIMFTVALLCSDGHPXRPGVLPGPLLYLECRILGSSD

SEQ ID NO: 3415 - protein, 45 aa, Homo sapiens
MAAAKALISLWLVSACGQWETSFPIYGGDMECQAVVFWWLEEERK

SEQ ID NO: 3416 - protein, 43 aa, Homo sapiens
MAPLPTPLTALGASHLPFRCLSCLDACLFLWGYLNSAHPIGAS

SEQ ID NO: 3417 - protein, 74 aa, Homo sapiens
MLLPQILAWLTPLCSGFCQAVTFSMRPTWATIFNTAVYTASPPTTQHSQALTLLPLFFPFRQPSSNTWDHILIY

SEQ ID NO: 3418 - protein, 34 aa, Homo sapiens
MQCPYLLGAQLLVSSICPVVPALPRPVNKCLVPD

SEQ ID NO: 3419 - protein, 25 aa, Homo sapiens
MSMLFLFCVHVSLLIFLICSPMLYL

SEQ ID NO: 3420 - protein, 17 aa, Homo sapiens
IVILCMCAFSLWVIVRI

SEQ ID NO: 3421 - protein, 21 aa, Homo sapiens
MLAALACSWRLLSLGAHSGRA

SEQ ID NO: 3422 - protein, 64 aa, Homo sapiens
MSSFGKCLFILVLGLFFNWVFVFFFAIDFLKFLDSNLLSDMWFTNIFSYSVDCLFILSIISFAL

SEQ ID NO: 3423 - protein, 59 aa, Homo sapiens
MPGPHQLCLINAGQPCSLVTSVGHWLLGVFSILPCSLLAPGEKGPYRSLFQVTRSWGGP

SEQ ID NO: 3424 - protein, 41 aa, Homo sapiens
MTTSSLAVGCFGWLRLLLHFLDPGNYSHQDDMDQSTVFKHD

SEQ ID NO: 3425 - protein, 6 aa, Homo sapiens
MPFYPC

SEQ ID NO: 3426 - protein, 38 aa, Homo sapiens
MGVLPGLFPFPPSLATVLGVWQLFGFFFFLQLCVCVFV

SEQ ID NO: 3427 - protein, 123 aa, Homo sapiens
ELLILNFCKCFLLQSMVFAKTCGSWRSQACLVGTSMRSVLNPRVKSGRFVKILPDYEHMAYRDVYTCLLHRYRHILGLWQPDIGPYGGLLNVVVDGLFIIVMRRAPPICTVHSTSIAFLFYFF

SEQ ID NO: 3428 - protein, 124 aa, Homo sapiens
  SITE (102): Xaa equals any amino acid
ELLILNFCKCFLLQSMVFAKTCGSWRSQACLVGTSMRSVLNPRVKSGRFVKILPDYEHMAYRDVYTCLLHRYRHILGLWQPDIGPYGGLLNVVVDGLFIIGXMRRAPPICTVHSTSIAFLFYFF

SEQ ID NO: 3429 - protein, 123 aa, Homo sapiens
MVWLPRPSLGWVWGWSGLAHASHLCLHLCCHPAPPSSSSPTSSSLCASVSCRKKWVEPERRLSEEGRGRAWGGSPTPHPKPQGLPPGSGRGRSWLCGVVAPLLLPCFSHLSCPSLVPTAVHHE

SEQ ID NO: 3430 - protein, 43 aa, Homo sapiens [sequence omitted]

SEQ ID NO: 3431 - protein, 27 aa, Homo sapiens
SFYVLFSNLQWYVFNIFATYTLGKKKM

SEQ ID NO: 3432 - protein, 33 aa, Homo sapiens
MLRQVFFFPLCLGPVRGLLRTVSVIEGLYSFQL

SEQ ID NO: 3433 - protein, 10 aa, Homo sapiens
NTMIAAGSCD

SEQ ID NO: 3434 - protein, 43 aa, Homo sapiens
MTLWKCGRTTLRASLLMIFTSCSWWLGVCLSVLVRQRCQENDG

SEQ ID NO: 3435 - protein, 71 aa, Homo sapiens
WTPSRPRHPWGRWTLATWWPHWTRGLPVTSPLPAITTPSSSHLGRLPLWGPRIRLCLVPCCWSWPRPSTGS

SEQ ID NO: 3436 - protein, 39 aa, Homo sapiens
MAAKSATYWGWHWVDWRWWCTACGVLRFWSGCREGSQLC

SEQ ID NO: 3437 - protein, 51 aa, Homo sapiens
MCWYVISRPLWLNRLCMSSRLFVLPQPSVLITLRPAASVGFLPVGEHISRL

SEQ ID NO: 3438 - protein, 20 aa, Homo sapiens
MLFVLLIWKLYMIYIKTFCF

SEQ ID NO: 3439 - protein, 39 aa, Homo sapiens
LFWSVSETGIAFGVSRVLGMLEGHLQEAWGRREISCDAL

SEQ ID NO: 3440 - protein, 198 aa, Homo sapiens
MFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 3441 - protein, 28 aa, Homo sapiens
MFQDQELSKLPSAFYLSSIQFNSNHSLP

SEQ ID NO: 3442 - protein, 24 aa, Homo sapiens
MILISVIPSFFPVISAVQTTYEQC

SEQ ID NO: 3443 - protein, 83 aa, Homo sapiens
MCVFVYELMLLSLVFLPHWSLPSLPYFSFALHSNTVKPDIYFLCGSNSLIFPVDKRYVFYSFISLIVNRKQLENWNTFSLCGC

SEQ ID NO: 3444 - protein, 28 aa, Homo sapiens
MPVWKCLLWCTPLLRCTQLLLQLQSRCC

SEQ ID NO: 3445 - protein, 33 aa, Homo sapiens
MCSFHINFCLLSSTFILLTGLCFSVYASNIWVC

SEQ ID NO: 3446 - protein, 88 aa, Homo sapiens
SLKIFSVSGVLQGWPLAPEPLPQCSHQPPPHPSVCRASSTGPHAAFFTHSALGRFVIWLSLHWAEVCVHRVGVPSSPFHSEGHTQRCQ

SEQ ID NO: 3447 - protein, 65 aa, Homo sapiens
MSGAPTAGAALMLCAATAVLLSAQGGPVQSKSPRFASWDEMNVLAHGLLQLGQGLREHAEAPAVS

SEQ ID NO: 3448 - protein, 11 aa, Homo sapiens
ERSSLMSCAFF

SEQ ID NO: 3449 - protein, 72 aa, Homo sapiens
METPQLQVQGQLLHLLLCLYHHKVVQQKLLLLILLKLLKVTTLYPMEQILGSFHQLERSFIGIILSHRLLRP

SEQ ID NO: 3450 - protein, 20 aa, Homo sapiens
MSGVKLQLFGTRLSLPLSSY

SEQ ID NO: 3451 - protein, 26 aa, Homo sapiens
  SITE (3): Xaa equals any amino acid
MAXGSFLFFCLVHINVATSFLDLGLS

SEQ ID NO: 3452 - protein, 25 aa, Homo sapiens
MTCHIQFVFVPTVRGLNFIILAFCS

SEQ ID NO: 3453 - protein, 30 aa, Homo sapiens
MNSYMCACVFSSEIHLGGGFFCFFNSVPDL

SEQ ID NO: 3454 - protein, 93 aa, Homo sapiens
MRLTDSLFLWVGATPHLRNLAVAMCSRYDSIPVSTSLLGDTSDTTSTGLAQRLARKTNKQVFVSYNLQNTDSNFALLVENRIKEEMEAFPEKF

SEQ ID NO: 3455 - protein, 45 aa, Homo sapiens
MCCWIRFASILLRIFTPMFIRDIGLKFCFFVVSLPSFVIRMMLAS

SEQ ID NO: 3456 - protein, 19 aa, Homo sapiens
MSLLLESCVEPLSFLLLLQ

SEQ ID NO: 3457 - protein, 17 aa, Homo sapiens
MCALGKLCLILQSWHPL

SEQ ID NO: 3458 - protein, 37 aa, Homo sapiens
LISLAFLLPGILGKTNGFSRHPLSTNAFLKQTGTFLL

SEQ ID NO: 3459 - protein, 69 aa, Homo sapiens
MKLLLCFWVNRCACQLACVLSKFHKLKVFKGCVVSELYVSFLSLYLQRVRNEIYTSKVSLINMAFCFSM

SEQ ID NO: 3460 - protein, 69 aa, Homo sapiens; identical to SEQ ID NO: 3459

SEQ ID NO: 3461 - protein, 17 aa, Homo sapiens
SVWGSFLSMLMLLLSVC

SEQ ID NO: 3462 - protein, 28 aa, Homo sapiens
MAISYVSSWIILLDYLGSKDGFQLFPES

SEQ ID NO: 3463 - protein, 19 aa, Homo sapiens
QRPWILTTDLSVFFLCLFP

SEQ ID NO: 3464 - protein, 38 aa, Homo sapiens
MPCGHLRIRAGIAGGSGAAQSLLFPYLESLWECDFDRA

SEQ ID NO: 3465 - protein, 47 aa, Homo sapiens
MNVLCGYGLPIGRWFWGLRIILKLSLTDSPVFYKLTTNLSKDHLGRH

SEQ ID NO: 3466 - protein, 35 aa, Homo sapiens
HSCGPDTCVCPSPVSPCLPVPLAALMVTPKGSNPC

SEQ ID NO: 3467 - protein, 16 aa, Homo sapiens
FLISLCILIPFLILSP

SEQ ID NO: 3468 - protein, 16 aa, Homo sapiens
FLISLCILIPFLILSP

SEQ ID NO: 3469 - protein, 34 aa, Homo sapiens
MWPLIGYLTKSLLNFILCVIIAMCLCVLSSSDTY

SEQ ID NO: 3470 - protein, 35 aa, Homo sapiens
MTSLLQNCVIFVKVVQYMTFNFFFFFFFFFFFFFW

SEQ ID NO: 3471 - protein, 134 aa, Homo sapiens
MLKLILLLLFSGATLSSTWFTLNCLNSITHLPLTTVTLYASCILLGVFLNSSVPIFFELFVETVYPVPEGITCGVVTFLSNMFMGVLLFFLTFYHTELSWFNWCLPGSCLLSLLLILCFRESYDRLYLDVVVSV

SEQ ID NO: 3472 - protein, 39 aa, Homo sapiens
MIVQESPFLTMDLLESCFPYVLLRNAYHAVYKQSVTSSA

SEQ ID NO: 3473 - protein, 35 aa, Homo sapiens
IAWVQRTSCSCFGIGDWYRESARPPEQYVQLPRTP

SEQ ID NO: 3474 - protein, 80 aa, Homo sapiens
MGRMAILACSLPTTWSSLSEAEGTSCPSPLRHGFLIAGRGGLGVDIQHSSRNRTPSEDEASGLPPAWQTQPVTPNAAMAW

SEQ ID NO: 3475 - protein, 13 aa, Homo sapiens
MKLFCVLIVVVVT

SEQ ID NO: 3476 - protein, 26 aa, Homo sapiens
MSQACFPISVKLFETLLCLCFVCACV

SEQ ID NO: 3477 - protein, 25 aa, Homo sapiens
PGHLWGQSCASLPPCALSSELPEFL

SEQ ID NO: 3478 - protein, 44 aa, Homo sapiens
ICVANYRLWCKVCLIFLPLTPANCCILDSLFQYCIKTLVLCWTE

SEQ ID NO: 3479 - protein, 253 aa, Homo sapiens
MNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQRLSAGQTEASVYQQAEDGKTELSLMHFAITNPGWQPPRESTAFLGFSRSRFSGMEQLLASPKGVCSLKMPSLRLSSPYNLSLSP

SEQ ID NO: 3480 - protein, 65 aa, Homo sapiens
MAPSTATRHWHAHCFASCRSTGMQRLCGPGIPKNSLPVTSWWTWGASTTLGDTDMTITRGLSQRP

SEQ ID NO: 3481 - protein, 63 aa, Homo sapiens
MQIHMIPVTYELKIRCLLLFVSFSRKMSQQPIRKLYQSTLDYKLTETINNKATQYEYNTPKGT

SEQ ID NO: 3482 - protein, 31 aa, Homo sapiens
MCCSCCGRYPWVLGKHMCSLLWLQIPAYLKS

SEQ ID NO: 3483 - protein, 46 aa, Homo sapiens
GIIQSVLFCAWFVLVNIASGSFISVQGWRTPAYKPNLVLCLFSYGL

SEQ ID NO: 3484 - protein, 9 aa, Homo sapiens
AGAGLPPGS

SEQ ID NO: 3485 - protein, 72 aa, Homo sapiens
MGYNLSPQFTQLLVSRYCPRSANPAMQLDRFIQVCTQLQVLTEAFREKDTAVQGNIRLSFEDFVTMTASRML

SEQ ID NO: 3486 - protein, 10 aa, Homo sapiens
MPLHSSLGGH

SEQ ID NO: 3487 - protein, 10 aa, Homo sapiens
GLVAAVRFIS

SEQ ID NO: 3488 - protein, 33 aa, Homo sapiens
MHLAFHIVFILQAIACFSCSLPVLAAGVDRLLS

SEQ ID NO: 3489 - protein, 26 aa, Homo sapiens
IFLHLLSCSLLFAWTNGEKSAQNEIM

SEQ ID NO: 3490 - protein, 22 aa, Homo sapiens
MNILFILCNLIWLLWGKQHVHK

SEQ ID NO: 3491 - protein, 63 aa, Homo sapiens [sequence omitted]

SEQ ID NO: 3492 - protein, 37 aa, Homo sapiens
MLCQRSVGYKYLALFLGCLFCSIGLCTCCYTSPMLFW

SEQ ID NO: 3493 - protein, 36 aa, Homo sapiens
MISVWFDVLFLSSVSAWVSVCMKWNKLPTAKKKKKK

SEQ ID NO: 3494 - protein, 36 aa, Homo sapiens
  SITE (31): Xaa equals any amino acid
  SITE (33): Xaa equals any amino acid
MSSLLLIIILALSLAYKKKKKKLEGGPGTHXPXGGV

SEQ ID NO: 3495 - protein, 10 aa, Homo sapiens
WHPVCSWCLH

SEQ ID NO: 3496 - protein, 13 aa, Homo sapiens
  SITE (12): Xaa equals any amino acid
MWLVHRRLMSLXL

SEQ ID NO: 3497 - protein, 91 aa, Homo sapiens
MVTFSTALTILIMNLHYCGPSVRPVPAWARALLLGHLARGLCVRERGEPCGQSRPPELSPSPQSPEGGAGPPAGPCHEPRCLCRQKPYCTT

SEQ ID NO: 3498 - protein, 27 aa, Homo sapiens
PAPHLPRLTLPCQVVWGPRCWGGESGS

SEQ ID NO: 3499 - protein, 70 aa, Homo sapiens
MCDVLWGLFILLVHRRGTLPQESRHLSSSSSSSSATEEPPYLGQVSHCLPVMFTTHERTRRFDVSIKLNE

SEQ ID NO: 3500 - protein, 41 aa, Homo sapiens
  SITE (40): Xaa equals any amino acid
MLLGLLVILVINLWMRQVLISTEFFNRRLCYRSYRFFPGXA

SEQ ID NO: 3501 - protein, 4 aa, Homo sapiens
DKLM

SEQ ID NO: 3502 - protein, 14 aa, Homo sapiens
GKGRLSRGKYYQSS

SEQ ID NO: 3503 - protein, 62 aa, Homo sapiens
DILRLFVALQGCMAGRAGQRPESQRTCPPGVESEWRAGSTGSGAVCHCGGGQADKTQEGDCQ

SEQ ID NO: 3504 - protein, 42 aa, Homo sapiens
LPGSRSRCFIFPLFSHYIVISPTLSLVLFFSWKTRKPLSPKC

SEQ ID NO: 3505 - protein, 66 aa, Homo sapiens
DLLLLFCGDVPCSLYVSSHVCLCTHIASCAVFVSLPLMPASGMMERLWSRLRIMTAYKTDSTLTGK

SEQ ID NO: 3506 - protein, 11 aa, Homo sapiens
MCLPLMPSWPR

SEQ ID NO: 3507 - protein, 265 aa, Homo sapiens
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 3508 - protein, 21 aa, Homo sapiens
EKQLYLESYCLGFLIRHSSPD

SEQ ID NO: 3509 - protein, 21 aa, Homo sapiens
  SITE (14): Xaa equals any amino acid
MAGRVGYLRYCLFXISALLIF

SEQ ID NO: 3510 - protein, 62 aa, Homo sapiens
MCNLPENLFCFWSTSGVASGPRAFATVLPPAPTSSVCLQSLIYRSPRCLLYSLCAWPFCYLA

SEQ ID NO: 3511 - protein, 60 aa, Homo sapiens
ELWWFWLLWTVLILFSCCCAFRHRRAKLRLQQQQRQRRNQLVGLSWGMPWGWSFPYRFTA

SEQ ID NO: 3512 - protein, 125 aa, Homo sapiens
GRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGCQRHTRRGCSKVFPGLR

SEQ ID NO: 3513 - protein, 38 aa, Homo sapiens
MLPNFSWLLLLCHTAHRSCPPPPYTPRPHPPVRQFKSC

SEQ ID NO: 3514 - protein, 59 aa, Homo sapiens
MLSQTNGSHVASTLLSFAVAWLGILGSSPSPTLSAPSQFLPGPHTLLQLPTLLQSHCRP

SEQ ID NO: 3515 - protein, 14 aa, Homo sapiens
HSSISRSSLSCPYS

SEQ ID NO: 3516 - protein, 33 aa, Homo sapiens
MFWTNLVQYVFCLSFFILLLSQQVENLALLGSM

SEQ ID NO: 3517 - protein, 27 aa, Homo sapiens
  SITE (2): Xaa equals any amino acid
  SITE (6): Xaa equals any amino acid
  SITE (18): Xaa equals any amino acid
  SITE (20): Xaa equals any amino acid
MXLVHXIIVLIFLPGMTXKXERRKKMC

SEQ ID NO: 3518 - protein, 4 aa, Homo sapiens
FVCI

SEQ ID NO: 3519 - protein, 137 aa, Homo sapiens
LFLLFLVFELPWRRAWETSRGQATDLRTSPPVLGAGRPRSGVSTHARLKRRRRDPLPDRARPPPPLLPQGAWTAGLTCSLLRVCPRTSPPAPRWWRGHGYLSLLLLAWRRAVPALGFWDSSPPGAFCSPCGLSDPSP

SEQ ID NO: 3520 - protein, 50 aa, Homo sapiens
ENSFKKNMSLGSCVVLLPGCKLSPPRASHYHQTSSGPGCEALFLVFRMDL

SEQ ID NO: 3521 - protein, 31 aa, Homo sapiens
MAPLRRLTVWRVGLRLGPAGAAGGPGEASSV

SEQ ID NO: 3522 - protein, 4 aa, Homo sapiens
MWNW

SEQ ID NO: 3523 - protein, 20 aa, Homo sapiens
MGATARPGPTRGRWDSCLRQ

SEQ ID NO: 3524 - protein, 22 aa, Homo sapiens
MPFYIHLWHQMLLIIIVMWWIC

SEQ ID NO: 3525 - protein, 56 aa, Homo sapiens
MRSIWKPTRCWPLCTLLRSTSSQHWQKPVSTFWRQVWKPRTPASCCPRAGCLRSPS

SEQ ID NO: 3526 - protein, 23 aa, Homo sapiens
MLKQLLMIAVGVKLQWKLWLQNR

SEQ ID NO: 3527 - protein, 5 aa, Homo sapiens
MVKNL

SEQ ID NO: 3528 - protein, 45 aa, Homo sapiens
AAAFVGWLSGLLGFSFMVARWHYSNSSIMFVFKTEGKGDGLYQSL

SEQ ID NO: 3529 - protein, 36 aa, Homo sapiens
MAWRWWAKGGPSRLLLWKTTQCLKEVREAPLKTQHT

SEQ ID NO: 3530 - protein, 32 aa, Homo sapiens
MALLILLFCILKYKQLDIAEDGSGGQGQISQM

SEQ ID NO: 3531 - protein, 32 aa, Homo sapiens; identical to SEQ ID NO: 3530

SEQ ID NO: 3532 - protein, 7 aa, Homo sapiens
MGLWWRC

SEQ ID NO: 3533 - protein, 7 aa, Homo sapiens
MGLWWRC

SEQ ID NO: 3534 - protein, 323 aa, Homo sapiens
  SITE (217): Xaa equals any amino acid
  SITE (226): Xaa equals any amino acid
  SITE (229): Xaa equals any amino acid
MELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRENPMVIPGNADHLHRTSIHQLPPATNRLATHWEPCLWAQTERLCCCFLCPVRSPGDVAHMMYSQVFQATVNLGPEDWRPHVWNYGWAFYMACSPSXAAWRRLSPXSTXTPGWCWSSSASIVKSFKENPNCLPHHHQCFPRRLSSAAPTVGPLTSYHQYHNQPIHSVSEGVDFYSELRNKGFQRGASQELKEAVRSSVEEEQC

SEQ ID NO: 3535 - protein, 37 aa, Homo sapiens
VLSCWTWMTWCGWLCPTPSASTHTSRNCTAALCRKDW

SEQ ID NO: 3536 - protein, 7 aa, Homo sapiens
FVKLRHP

SEQ ID NO: 3537 - protein, 88 aa, Homo sapiens
  SITE (28): Xaa equals any amino acid
  SITE (67): Xaa equals any amino acid
  SITE (73): Xaa equals any amino acid
  SITE (74): Xaa equals any amino acid
AWLSHLMEHHSSHGGRKRYACQGCWKTXHFSLALAEHQKTHEKEKSYALGGARGPQPSTRESQAGAXAGGPPXXVEGEAPPAPPEAQR

SEQ ID NO: 3538 - protein, 34 aa, Homo sapiens
MAAMRHLLRLFSGCGDLGFLTLYIFFLYSKQNNF

SEQ ID NO: 3539 - protein, 23 aa, Homo sapiens
MPFLHTPTVPSIFLRVIIFLFTL

SEQ ID NO: 3540 - protein, 38 aa, Homo sapiens
MLRLAGPPFYWPVLLALLPFASSGFQVSLKVGGCLSSL

SEQ ID NO: 3541 - protein, 12 aa, Homo sapiens
MTSVQQFCIYSE

SEQ ID NO: 3542 - protein, 56 aa, Homo sapiens
MNLWLGALIPVTVHLKRMWSHPKFQAQKTFPLSKSPKYHPVFLLVIIMARSSQLKR

SEQ ID NO: 3543 - protein, 84 aa, Homo sapiens
  SITE (58): Xaa equals any amino acid
MLVSSHFLFLCFVRLLSSLPLFLTSITFLYSPSSPSLFLSLYSFSYPSFSPLSFLPLXLISFPPPMPSSLFPFPCFFPQPLFLF

SEQ ID NO: 3544 - protein, 1 aa, Homo sapiens
M

SEQ ID NO: 3545 - protein, 20 aa, Homo sapiens
MPQASTHIKAPPPPSPEPGN

SEQ ID NO: 3546 - protein, 129 aa, Homo sapiens
MFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFASASREYPSTLPSKPCIPEVMVAPRP

SEQ ID NO: 3547 - protein, 13 aa, Homo sapiens
QKAALRLPFPVLL

SEQ ID NO: 3548 - protein, 33 aa, Homo sapiens
MASTTLWLLWKTWLSSGLRCVQRVPSRVFYSGC

SEQ ID NO: 3549 - protein, 8 aa, Homo sapiens
MSLLLFLF

SEQ ID NO: 3550 - protein, 36 aa, Homo sapiens
MTSGEPWACAGCSFPATAAASDFASVLPGVEGSVCC

SEQ ID NO: 3551 - protein, 69 aa, Homo sapiens
MSHFRPARCLPGPCQTLLTFPLLVCAGLRRPPRPHSTQPGSSCSPRHPSFPSLSWVMLLPPCVTFEAVK

SEQ ID NO: 3552 - protein, 207 aa, Homo sapiens
MGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 3553 - protein, 31 aa, Homo sapiens
WLLLCQGHFWVSATATGALGGEGHRVLLGRW

SEQ ID NO: 3554 - protein, 23 aa, Homo sapiens
MFQAPALAFLSGLQLSFVACSIY

SEQ ID NO: 3555 - protein, 37 aa, Homo sapiens
MGLWVFLELVFVHSLLFVLPSLSPCPTHVLRHSGSTW

SEQ ID NO: 3556 - protein, 38 aa, Homo sapiens
MLSPSQTPGSCLKWAPSWVTRCTFWTLVVASLAQKGPK

SEQ ID NO: 3557 - protein, 75 aa, Homo sapiens [sequence omitted]

SEQ ID NO: 3558 - protein, 75 aa, Homo sapiens [sequence omitted]

SEQ ID NO: 3559 - protein, 75 aa, Homo sapiens [sequence omitted]

SEQ ID NO: 3560 - protein, 75 aa, Homo sapiens [sequence omitted]

SEQ ID NO: 3561 - protein, 75 aa, Homo sapiens [sequence omitted]

SEQ ID NO: 3562 - protein, 75 aa, Homo sapiens [sequence omitted]

SEQ ID NO: 3563 - protein, 30 aa, Homo sapiens
FCLFVCLFCMAHVFTIPGALPSFVWIQFSI

SEQ ID NO: 3564 - protein, 21 aa, Homo sapiens
MWLSAFFLARLADSVLEESII

SEQ ID NO: 3565 - protein, 27 aa, Homo sapiens
MASWICVFCTSPSGCSATCLVCYPAFP

SEQ ID NO: 3566 - protein, 34 aa, Homo sapiens
MLFFFSIALSSFFFLNLFLCLCNSRVIGIVLTIS

SEQ ID NO: 3567 - protein, 71 aa, Homo sapiens
ERCLSLLFAAIIKIPIHGVNYNEEKFISWSSGGWGVPKSRCWHLVRSFLLSTPWWRVEGQKEREGWRPIGG

SEQ ID NO: 3568 - protein, 32 aa, Homo sapiens
MSVFRVIQILLFPFSLRYSLGDLMYLNLTTIY

SEQ ID NO: 3569 - protein, 118 aa, Homo sapiens
MDLAGLLKSQFLCHLVFCYVFIASGLIINTIQLFTLLLWPINKQLFRKINCRLSYCISSRLQGPGQERAGLCPNYRLDVVLHRDGLLFAQVGAGSQDGCHQFAAPPGLPREVFFPDSL

SEQ ID NO: 3570 - protein, 42 aa, Homo sapiens
EWVKGIVIWQFYLLFYACLSSACLFSPSANIPFMPWAFSTVL

SEQ ID NO: 3571 - protein, 63 aa, Homo sapiens
  SITE (45): Xaa equals any amino acid
  SITE (49): Xaa equals any amino acid
YITSCRLTTSFFCCFRNLLSIIRLQDSASSCLDSISKSPSSCPSXMSVXTPQYIKKSISESGL

SEQ ID NO: 3572 - protein, 54 aa, Homo sapiens
MWCLSHLSLSLSLSHLSLARRAGRPMPWCPATQLVILWLQNWWSPMMDMRRSLR

SEQ ID NO: 3573 - protein, 58 aa, Homo sapiens
MGFPLWITRPFSLAALNVFFIPFNLGESDDYVSWGCSSREVSLWWSLSFLNLNVGLSC

SEQ ID NO: 3574 - protein, 58 aa, Homo sapiens; identical to SEQ ID NO: 3573

SEQ ID NO: 3575 - protein, 33 aa, Homo sapiens
LPRLQSALLLLPLPPTLQGHVRAPIYPPPACRS

SEQ ID NO: 3576 - protein, 18 aa, Homo sapiens
MPHPCLPVSTHLEGRWGC

SEQ ID NO: 3577 - protein, 266 aa, Homo sapiens
MQIVKLLGLDVPSLCLAELVKTYCSSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPEWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 3578 - protein, 8 aa, Homo sapiens
SLFWGCPW

SEQ ID NO: 3579 - protein, 28 aa, Homo sapiens
MKKRLSPLSWARCCLCFWLQWGRRTNRL

SEQ ID NO: 3580 - protein, 81 aa, Homo sapiens
MYLHSLPFCFAGISCLCCLSKLPVEILSILIINMSLDSYRLYQPALSFCQTELSPLFPYKADLYSCFSRYCLYISLFHSPL

SEQ ID NO: 3581 - protein, 12 aa, Homo sapiens
AGGLGLHARCWR

SEQ ID NO: 3582 - protein, 22 aa, Homo sapiens
ILIFMVFPFVLVFASLTSVISI

SEQ ID NO: 3583 - protein, 18 aa, Homo sapiens
MVAWTSTWSRAWQSTLRM

SEQ ID NO: 3584 - protein, 151 aa, Homo sapiens
  SITE (4): Xaa equals any amino acid
  SITE (9): Xaa equals any amino acid
  SITE (14): Xaa equals any amino acid
  SITE (17): Xaa equals any amino acid
  SITE (36): Xaa equals any amino acid
  SITE (69): Xaa equals any amino acid
  SITE (71): Xaa equals any amino acid
  SITE (87): Xaa equals any amino acid
  SITE (92): Xaa equals any amino acid
  SITE (95): Xaa equals any amino acid
  SITE (108): Xaa equals any amino acid
  SITE (119): Xaa equals any amino acid
  SITE (150): Xaa equals any amino acid
MRVXAPRTXLLLLXGAXALTETWAGSHSMRYFYTAXSRPGRGEPRFIAVGYVDDTQFVRFDSDARVRGXSXGRLRRQGLHRPERGPXLLDRXGHXGSDHPAQVGGGPXGGAAESLPGGXVRGVAPQIPGEREGDAAARGPPKDTRDPPPXL

SEQ ID NO: 3585 - protein, 132 aa, Homo sapiens
LLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 3586 - protein, 66 aa, Homo sapiens
ETVGCGFSLSFFFNFLCWVFEQPHVPFPGSLLIYLLELKWMGSRALCVSMLCFLTRLHSEALMPFG

SEQ ID NO: 3587 - protein, 29 aa, Homo sapiens
MATLSLRAGLGFCFLLGLTEYFVGFHLIP

SEQ ID NO: 3588 - protein, 29 aa, Homo sapiens
MLIRLYMVCGCFLPTTVELNSCIRDLMAC

SEQ ID NO: 3589 - protein, 16 aa, Homo sapiens
MTCCLLRSGVPVCLSL

SEQ ID NO: 3590 - protein, 78 aa, Homo sapiens
MSPHQPMQVSSSKTILWLVLSCLCPSSPHPVISGLPQWYIGVLAGIVPVAPIRPGDSGLDLQREGPQPILSQGLNRRT

SEQ ID NO: 3591 - protein, 37 aa, Homo sapiens
MGLRRHFPALWVLWWPWCPSWRQTRTPSAPSMQMATR

SEQ ID NO: 3592 - protein, 26 aa, Homo sapiens
CGTAYCLFTPSPGMPQASAFHCSSLF

SEQ ID NO: 3593 - protein, 39 aa, Homo sapiens
ALRGPAFNWLLCCSSTIFCRAQIALLPLSPASTPSPTTR

SEQ ID NO: 3594 - protein, 33 aa, Homo sapiens
MLLGTYFKVYLIFKCFYIFLYKSRKMHFHLQKS

SEQ ID NO: 3595 - protein, 32 aa, Homo sapiens
  SITE (9): Xaa equals any amino acid
MGLVERLLXCFTHGLWQFAQTAPIRTPLAAFA

SEQ ID NO: 3596 - protein, 196 aa, Homo sapiens
MWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 3597 - protein, 47 aa, Homo sapiens
MRQRQSHYCSVLFLSVNYLGGTFPVYQKSRNLQRDKIQETFAQKRIK

SEQ ID NO: 3598 - protein, 46 aa, Homo sapiens
GRRRAQLLWHIIFLQLYFWARWQREGSVMPPHRHSIRRRVDSFWML

SEQ ID NO: 3599 - protein, 22 aa, Homo sapiens
MLLAVILQLIPPVTKAFVYELT

SEQ ID NO: 3600 - protein, 5 aa, Homo sapiens
MPCLF

SEQ ID NO: 3601 - protein, 29 aa, Homo sapiens
MGKKHHVGRTAWVFALVVVCILGPLLCSS

SEQ ID NO: 3602 - protein, 43 aa, Homo sapiens
MVPLLRLCSSFVLLLFCYVTAKKKKKKEKKSANCVHAFLPAGM

SEQ ID NO: 3603 - protein, 90 aa, Homo sapiens
MNIKCFVMCGGLYLASILVTWREHGSPHFLDEHTNVLRKCMIGSKLQNHLPSRIIPIICTASPGANGFIQRGSTELWVIRRQYPRVRVFP

SEQ ID NO: 3604 - protein, 50 aa, Homo sapiens
MYIFELSLYLEGTSFVVVLLFLLISVSLDSPPTTKGWGLCLTYLGALIVQ

SEQ ID NO: 3605 - protein, 3 aa, Homo sapiens
VER

SEQ ID NO: 3606 - protein, 35 aa, Homo sapiens
MFPCCWAHLQRGGKVLCLLVLLVLSLPTEHHVANK

SEQ ID NO: 3607 - protein, 32 aa, Homo sapiens
MGSWLWTVANLLHIPPNLYRMLAGRWQRAHWD

SEQ ID NO: 3608 - protein, 24 aa, Homo sapiens
MASELARLLHAFGLMGPRKAGESS

SEQ ID NO: 3609 - protein, 66 aa, Homo sapiens
  SITE (31): Xaa equals any amino acid
MQLEALNLLHTLVWARSLCRAGAVQTQERLXGSASPEQVPAGECCALQEYEAAVGAAQERADPGAG

SEQ ID NO: 3610 - protein, 62 aa, Homo sapiens
  SITE (25): Xaa equals any amino acid
MLPSPKPAPLPHFPVAPLVLFAHWXLCSSKGVLPEVRGLSLHPLGHGAAVPALPLPEAAAPA

SEQ ID NO: 3611 - protein, 62 aa, Homo sapiens
  SITE (25): Xaa equals any amino acid
  SITE (45): Xaa equals any amino acid
MLPSPKPAPLPHFPVAPLVLFAHWXLCSSKGVLPEVRGLSLHPLXHGAAVPALPLPEAAAPA

SEQ ID NO: 3612 - protein, 17 aa, Homo sapiens
QTHYYDLPKDSLQVVNH

SEQ ID NO: 3613 - protein, 40 aa, Homo sapiens
MRMKTRTKTLRKAQMLFRLLTLRMDLLVLLLPRLDCPQTR

SEQ ID NO: 3614 - protein, 5 aa, Homo sapiens
MKAHH

SEQ ID NO: 3615 - protein, 36 aa, Homo sapiens
MMFSLLLTTCLSRKACGVRMMWPISMWKQRKETDIA

SEQ ID NO: 3616 - protein, 36 aa, Homo sapiens; identical to SEQ ID NO: 3615

SEQ ID NO: 3617 - protein, 32 aa, Homo sapiens
MPAWKCPCIRGLLHSLLLREASASAQGVCAAL

SEQ ID NO: 3618 - protein, 112 aa, Homo sapiens
  SITE (27): Xaa equals any amino acid
MPLFLSIPSLFLTLSGLGLAVQSPAGXCWGLSLCRHCVFLRGCPQNTPPAPWGSSGSHFSWSLRSQKQLLQEAKKRLGWLLVLMMAFILLGHFGYIHGHCFHLSFLPVPPLP

SEQ ID NO: 3619 - protein, 40 aa, Homo sapiens
MQKFIQAMLRKLLLMQMMCDWQSSAALISLLPLLPQEIFY

SEQ ID NO: 3620 - protein, 40 aa, Homo sapiens
MCFNFKYFFLCGKCHVTIALPSVWTVLVLVLSVYQKSGCL

SEQ ID NO: 3621 - protein, 246 aa, Homo sapiens
MQPSWLTRCPTWPWPMGAAWPRRARSWWIRTSTASSPSPSSSITLLWTPCMWAESWACCSSPTYTRTGKCSTNRTPRWPPALTSMPRTSTFQQWAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 3622 - protein, 27 aa, Homo sapiens
  SITE (8): Xaa equals any amino acid
VFWPTSEXLLNCMVWGREGNLKSRPNK

SEQ ID NO: 3623 - protein, 111 aa, Homo sapiens
MTESFYPLNQRKQNENPSAVLMHLFLFSVTMQQVARTVAKVELSDHVCDVVFALFDCDGNGELSNKEFVSIMKQRLMRGLEKPKDMGFTRLMQAMWKCAQETAWDFALPKQ

SEQ ID NO: 3624 - protein, 47 aa, Homo sapiens
MTPPHVLLKGVLVVSRVCVSLLCCPPGCSVCCPLPPGGSPCFSPIYS

SEQ ID NO: 3625 - protein, 48 aa, Homo sapiens [sequence omitted]

SEQ ID NO: 3626 - protein, 25 aa, Homo sapiens
MVCIFKTEDVLPFLLLFFLFSFFFF

SEQ ID NO: 3627 - protein, 104 aa, Homo sapiens
MVAGTPCFLPLLSACVTHINGNNFFQLLAEVGEAGSLHREGLSSLLLPASFCFGCREWFIHTLIPSPPLVDGGLAFSIPVFWCLPLSATLNHLSWSCCVMGTCL

SEQ ID NO: 3628 - protein, 19 aa, Homo sapiens
VCLLCIPGAQNRAWHIVGA

SEQ ID NO: 3629 - protein, 83 aa, Homo sapiens [sequence omitted]

SEQ ID NO: 3630 - protein, 104 aa, Homo sapiens [sequence omitted]

SEQ ID NO: 3631 - protein, 59 aa, Homo sapiens
LLGTWLCPQLPPGLGAHHAPSSFSSYLCPVSPSIRLSDGTLWERLWPWSGGREQGGRHK

SEQ ID NO: 3632 - protein, 36 aa, Homo sapiens
  SITE (9): Xaa equals any amino acid
MGVFFILRXLTSQCFLSWFLGFVSAESFEQWSISGS

SEQ ID NO: 3633 - protein, 29 aa, Homo sapiens
  SITE (6): Xaa equals any amino acid
MCCHIXQIATVLLLSLCWLCATLMVPRNR

SEQ ID NO: 3634 - protein, 51 aa, Homo sapiens
MPWFVPLVSWEELAPAQLSCHWPFRVGLGPECLLVASHGGLMAQPSPKRAQ

SEQ ID NO: 3635 - protein, 27 aa, Homo sapiens
MALAGFFLPWTHCCRLSLKFLCGVTRS

SEQ ID NO: 3636 - protein, 15 aa, Homo sapiens
MLIVLLINLSSEPSC

SEQ ID NO: 3637 - protein, 3 aa, Homo sapiens
MST

SEQ ID NO: 3638 - protein, 32 aa, Homo sapiens [sequence omitted]

SEQ ID NO: 3639 - protein, 39 aa, Homo sapiens
MFQLCLEIFQFFVSVFISFLESLAEFQETVAHLLVMKCF

SEQ ID NO: 3640 - protein, 126 aa, Homo sapiens
MERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 3641 - protein, 35 aa, Homo sapiens
MKLSCCFFGALEWTFLAAVTLGPLPSRVLLCHRGC

SEQ ID NO: 3642 - protein, 31 aa, Homo sapiens
MLLCVLIVHCFLFLNSLALYGCPTVVYPLAS

SEQ ID NO: 3643 - protein, 15 aa, Homo sapiens
MNSGGSGWCGPSSSS

SEQ ID NO: 3644 - protein, 32 aa, Homo sapiens
MLSLALLWPIFILFTVQCHLFGNTQHQRVLPN

SEQ ID NO: 3645 - protein, 32 aa, Homo sapiens; identical to SEQ ID NO: 3644

SEQ ID NO: 3646 - protein, 46 aa, Homo sapiens
MNFFLGLWLLYILYILRILYTILIYCNTAVFDNLDSIWYMNFCIHY

SEQ ID NO: 3647 - protein, 66 aa, Homo sapiens
  SITE (61): Xaa equals any amino acid
MKRTLLSSVICLSASPAQGQAPWQCPAVTGDSAEVTYPEKPLHGLSRREKTALPGPWFGLXRGKGP

SEQ ID NO: 3648 - protein, 38 aa, Homo sapiens
MILSVLRNTGLCTSLFMGLWILFILRPVYNCFLPKGIV

SEQ ID NO: 3649 - protein, 57 aa, Homo sapiens [sequence omitted]

SEQ ID NO: 3650 - protein, 55 aa, Homo sapiens
MESLGPDIWLISGIASSPSFLHVLVVVVVGECGWGMSWLMPAKISSHPPCLSSLF

SEQ ID NO: 3651 - protein, 27 aa, Homo sapiens
MGALVELLYIFPFLLPSFLSEKLLEKK

SEQ ID NO: 3652 - protein, 36 aa, Homo sapiens
MPAGVGWWVCLHVRVCLGSFKGERGTHHHAGSALKR

SEQ ID NO: 3653 - protein, 34 aa, Homo sapiens
MLCLIAILLYVLVQYLVNPGVLRTDPRYEAAPGP

SEQ ID NO: 3654 - protein, 45 aa, Homo sapiens
MCILCYTQGPKFLQLFIHAIVLLFAEMEIIYTELQIPEMFHLYLI

SEQ ID NO: 3655 - protein, 23 aa, Homo sapiens
CLQWFVPLVPQQIPELILMTIWK

SEQ ID NO: 3656 - protein, 123 aa, Homo sapiens
MVWQPFFYLFNQEDAGELCCLSCWLVAALCPGVCMWVYLELLSLPSHCKLHPDETAVVLGLFHLSLPVPASSWLSCAWDMGLPICVFSKSGADQEHTKVWSCIITNIHSSGTFLRYIYKSFQQ

SEQ ID NO: 3657 - protein, 123 aa, Homo sapiens; identical to SEQ ID NO: 3656

SEQ ID NO: 3658 - protein, 87 aa, Homo sapiens [sequence omitted]

SEQ ID NO: 3659 - protein, 31 aa, Homo sapiens
MLVFVLLWISHLFSGRSEHCSLVQSSYFPSS

SEQ ID NO: 3660 - protein, 41 aa, Homo sapiens [sequence omitted]

SEQ ID NO: 3661 - protein, 35 aa, Homo sapiens
MTIICLLFLTLLLLLFKGIVQSSILYLWQQVKVSR

SEQ ID NO: 3662 - protein, 17 aa, Homo sapiens
LLCVLAGLTLLHHCQLA

SEQ ID NO: 3663 - protein, 58 aa, Homo sapiens
MQQKEPWAWSMQNWFLLQLLLLVGSGRKHIEFMIMVNLWRERGDQDEGASRRSCSSVH

SEQ ID NO: 3664 - protein, 19 aa, Homo sapiens
KFWFAFELFLFMWLLIISS

SEQ ID NO: 3665 - protein, 32 aa, Homo sapiens
MVLHFLDTILIFLIPPPTFQIASLMPQRLLCP

SEQ ID NO: 3666 - protein, 65 aa, Homo sapiens
  SITE (28): Xaa equals any amino acid
  SITE (42): Xaa equals any amino acid
MVPLLFLPLDSWLWREKKYHLLDADSEXIYSPLENSALPASXCHLAGAITESSKGHPIILLGQLL

SEQ ID NO: 3667 - protein, 18 aa, Homo sapiens
MEVFLYLGVVGFWHIGIS

SEQ ID NO: 3668 - protein, 30 aa, Homo sapiens
MNFQVWGTGQCTFLSLFILLFLKICNTYQR

SEQ ID NO: 3669 - protein, 32 aa, Homo sapiens
MISRGITIYLTVLLTYTVVLFYLFKSGFSAFH

SEQ ID NO: 3670 - protein, 32 aa, Homo sapiens
MALQAFSSLLLHILSTSTHYPVPKPLPHFQAL

SEQ ID NO: 3671 - protein, 37 aa, Homo sapiens
MVSVSRQTLVTFSLVYVPFLLLHIFGSKSYWLNQQGL

SEQ ID NO: 3672 - protein, 36 aa, Homo sapiens
MPGKLNPCLLWLLILMLFKKCKKASLVSKRSWIYIA

SEQ ID NO: 3673 - protein, 25 aa, Homo sapiens
MKKRLSPLSWARCCLCFWLQVGTTN

SEQ ID NO: 3674 - protein, 17 aa, Homo sapiens
MLSPGRCFAIWSLFLCS

SEQ ID NO: 3675 - protein, 65 aa, Homo sapiens
MPFWILPHVDCLCVCMFGVRMCETLLWFWESELYRTVYKMSLPHHPYSALLTLFFPPSSHSHSSF

SEQ ID NO: 3676 - protein, 9 aa, Homo sapiens
MFMMSVYIL

SEQ ID NO: 3677 - protein, 41 aa, Homo sapiens
MSMCKVRRGSLNYLLLFWLTSPIFKTLSNSQNLLMRHVVLN

SEQ ID NO: 3678 - protein, 66 aa, Homo sapiens
WLRFWCVFSSCSQLGLGLPKRWISVSTKIQQIITVSPFNPFRDKVRIIYNGTLALQGLFTWYLSYY

SEQ ID NO: 3679 - protein, 39 aa, Homo sapiens
MGASQCPFAAALRPLHFLLWVAALLGLQQPLQRLQLRNA

SEQ ID NO: 3680 - protein, 35 aa, Homo sapiens
MSIQIICCLWFFLYLITCQKPSLPLDFFILPSSEV

SEQ ID NO: 3681 - protein, 30 aa, Homo sapiens
MWQIAMITLWSLLVSGNHQLELRMLDTVPR

SEQ ID NO: 3682 - protein, 39 aa, Homo sapiens
MFQDILALCLWLLPGVWHHSVVTYNHCLGTHRVNCLSDK

SEQ ID NO: 3683 - protein, 33 aa, Homo sapiens [sequence omitted]

SEQ ID NO: 3684 - protein, 3 aa, Homo sapiens
MCA

SEQ ID NO: 3685 - protein, 33 aa, Homo sapiens
MIWSIVTCWICVCTGVFMQGRLNSQVRGESEPH

SEQ ID NO: 3686 - protein, 34 aa, Homo sapiens
MTVSFVMRFLALISNSFFLPLSLGATPDPCQVFL

SEQ ID NO: 3687 - protein, 33 aa, Homo sapiens
MSASILCSFVHSVFFISGCFSVVFRKMIITLFM

SEQ ID NO: 3688 - protein, 180 aa, Homo sapiens
MHQCEIWRELFSPLHALNFGIGGDGTQHVLWRLENGELEHIRPKIVVVWVGTNNHGHTAEQVTGGIKAIVQLVNERQPQARVVVLGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 3689 - protein, 35 aa, Homo sapiens
MKMNKLFWIRILKLLLQALSQCKLLIKGKLQCPRI

SEQ ID NO: 3690 - protein, 39 aa, Homo sapiens
MAMGHLVFISGIIQLVKGMYLSAWYPLQKSWNLTWHNKP

SEQ ID NO: 3691 - protein, 5 aa, Homo sapiens
MWTCK

SEQ ID NO: 3692 - protein, 39 aa, Homo sapiens
MFRRGFGSFCFCFLKHVFHSHLGILEAGQLAGFLGCRET

SEQ ID NO: 3693 - protein, 31 aa, Homo sapiens
MPCPFAHLVLLVVTSLVTGKVSKDIGVEHPG

SEQ ID NO: 3694 - protein, 35 aa, Homo sapiens
MVKLLVKLTFIISPLIKSSDSGITSLSCSYQRAIF

SEQ ID NO: 3695 - protein, 17 aa, Homo sapiens
MQKLKGGISVFLAFLLM

SEQ ID NO: 3696 - protein, 37 aa, Homo sapiens
MILKQGLICTWQVLLLASALEMLVFICAMECLTQFQV

SEQ ID NO: 3697 - protein, 53 aa, Homo sapiens [sequence omitted]

SEQ ID NO: 3698 - protein, 31 aa, Homo sapiens
MTESLLYLQLILLWGISEIPSSNTEMYRKCP

SEQ ID NO: 3699 - protein, 16 aa, Homo sapiens
MQKGRAVCLSPDLAHG

SEQ ID NO: 3700 - protein, 16 aa, Homo sapiens
MQKGRAVCLSPDLAHG

SEQ ID NO: 3701 - protein, 61 aa, Homo sapiens
MRVLILNVSMFLRSLAYILWCSHWKWKNGIIYIIYINIYYTYSPYFISVTIPIEFDKNCYD

SEQ ID NO: 3702 - protein, 5 aa, Homo sapiens
MHIIQ

SEQ ID NO: 3703 - protein, 92 aa, Homo sapiens
  SITE (32): Xaa equals any amino acid
MHFLFGYYVFSLTSASPALWAAASTCSSDLDXPCWVLVHLLIWCFVCHQYLHCSWWDVSHHLLYLLPTRKIKRSYFFPLRSNFSLDSWYPQF

SEQ ID NO: 3704 - protein, 11 aa, Homo sapiens
MFVCLFLINNI

SEQ ID NO: 3705 - protein, 120 aa, Homo sapiens
VVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKLSFHSSVFLLFMNGIRHR

SEQ ID NO: 3706 - protein, 44 aa, Homo sapiens
MDTWIFLLVTKIFKLFVYTHTHTHTHTHVSVPRNVYRGGQFSED

SEQ ID NO: 3707 - protein, 34 aa, Homo sapiens
  SITE (28): Xaa equals any amino acid
MIIWFLPFTLLVWFITFIDLFMLNHPCXPGINLT

SEQ ID NO: 3708 - protein, 5 aa, Homo sapiens
HACFL

SEQ ID NO: 3709 - protein, 32 aa, Homo sapiens
MFCGACQIGWNLWGLLWEMPREHRFRRWEQLV

SEQ ID NO: 3710 - protein, 23 aa, Homo sapiens
MSVQRWALKLTLILLVEKSLKAI

SEQ ID NO: 3711 - protein, 39 aa, Homo sapiens
  SITE (19): Xaa equals any amino acid
MLNNFLGINLQAWTSRLSXQFLLTFATYCYANFQKNCTQ

SEQ ID NO: 3712 - protein, 1 aa, Homo sapiens
M

SEQ ID NO: 3713 - protein, 49 aa, Homo sapiens
MAPKFFVSTGISPMAPIATAKPTAPPVLPASLPDRRCLQSHTQSSGHLP

SEQ ID NO: 3714 - protein, 72 aa, Homo sapiens
MWMSLVLHHSLPLGVTVALHCACFVAKNSGIPSGERSCFQGNRQAGSEVQEKATEAWKGSSCICASCARRTL

SEQ ID NO: 3715 - protein, 35 aa, Homo sapiens
MKTQNHCIFCIVILFSTSVPPLIWSWQCVSVHSLF

SEQ ID NO: 3716 - protein, 34 aa, Homo sapiens
MLKVCVCVCVCVCVCVSYPLKKGLYNKSASHWLL

SEQ ID NO: 3717 - protein, 5 aa, Homo sapiens
MNGLL

SEQ ID NO: 3718 - protein, 39 aa, Homo sapiens
MRSSGAWQAMVGVWILFLSAVESQGRVLAEQRCNLAWAL

SEQ ID NO: 3719 - protein, 26 aa, Homo sapiens
MYCISWEVYFMSFLAFFFPTATANEG

SEQ ID NO: 3720 - protein, 25 aa, Homo sapiens
MSLFFIWQLTKLLKAQPNCTFARTF

SEQ ID NO: 3721 - protein, 92 aa, Homo sapiens
  SITE (77): Xaa equals any amino acid
MAVLAGSLLGPTSRSAALLGGRWLQPRAWLGFPDAWGLPTPQQARGKARGNEYQPSNIKRKNKHGWVRRLSTPAGVXVILRRMLKGRKSLSH

SEQ ID NO: 3722 - protein, 35 aa, Homo sapiens
MIKLVHQIVILCVMRIVAGVILKCWYLDRTASPGF

SEQ ID NO: 3723 - protein, 72 aa, Homo sapiens
MLDVFLKSCFVSFLSLIVKLLNINRFAQPQRMRVDNTEEVMQKQKITLLIIDSITNKCLFLSLPPFLPLPSS

SEQ ID NO: 3724 - protein, 37 aa, Homo sapiens
MLLCTHTSLLLYFSFWMGLAKTGSGQRPPKLYVLPVS

SEQ ID NO: 3725 - protein, 17 aa, Homo sapiens
MPLGLPLSASGFSVGDL

SEQ ID NO: 3726 - protein, 66 aa, Homo sapiens [sequence omitted]

SEQ ID NO: 3727 - protein, 39 aa, Homo sapiens
MRFCCLILQILTRLVLTKYGRSGIRWKKEGSSCCCSYSC

SEQ ID NO: 3728 - protein, 34 aa, Homo sapiens
MWRWKAVTLMILTLSRSRLMCAFVSWFLTKKFKR

SEQ ID NO: 3729 - protein, 52 aa, Homo sapiens
MTASPDYLVVLFGITAGATGAKLGSDEKELILLFWKVVDLANKKVGQLHESS

SEQ ID NO: 3730 - protein, 45 aa, Homo sapiens
MRAAVQTCLPSQALASLTWQRLCPGLSPPRAMSLMAVLTERSQIV

SEQ ID NO: 3731 - protein, 35 aa, Homo sapiens
MLFMAHLLLRTHPLSLWVTSRQAKDWCFSFHPLEG

SEQ ID NO: 3732 - protein, 35 aa, Homo sapiens; identical to SEQ ID NO: 3731

SEQ ID NO: 3733 - protein, 70 aa, Homo sapiens
MSPSQSGVGISGLGLFLSKTPLFSLILKVIFLRTELLPKERDGFPRRHSWPSVDLSVHLLALLADSSGWA

SEQ ID NO: 3734 - protein, 102 aa, Homo sapiens
  SITE (72): Xaa equals any amino acid
MTGVQVQWTVIFLAPVIAVILCAMQTMLRSLWLMDLTLTVSQVVEERKQMKGKKKHGIQQKKTLELIVNMMXVARVGEKCSTCISKLNLMLQMKVLGKDING

SEQ ID NO: 3735 - protein, 36 aa, Homo sapiens
  SITE (16): Xaa equals any amino acid
MSHCWTLLALSLWGLXVSQGRETWWRWPHGLGPPCS

SEQ ID NO: 3736 - protein, 44 aa, Homo sapiens
LIGVFPPHLLSSLKCVPDAFICCFTSMFCFSSSLCSLPVYPLSL

SEQ ID NO: 3737 - protein, 10 aa, Homo sapiens
MIVTKMYFHV

SEQ ID NO: 3738 - protein, 16 aa, Homo sapiens
EKIDQQFTFAVCLVFV

SEQ ID NO: 3739 - protein, 12 aa, Homo sapiens
NWLDLFVLGFSS

SEQ ID NO: 3740 - protein, 53 aa, Homo sapiens
MGQRGVFLLILDAFSVPSTASCLITPLPPPHPQPSQFFLASALQPYLGKEEWV

SEQ ID NO: 3741 - protein, 53 aa, Homo sapiens; identical to SEQ ID NO: 3740

SEQ ID NO: 3742 - protein, 37 aa, Homo sapiens
MLQMCIYAQWYAYLCVTVSVASWLDPTISSEIMHPKG

SEQ ID NO: 3743 - protein, 17 aa, Homo sapiens
MLFFCQALFVLAVYYIF

SEQ ID NO: 3744 - protein, 38 aa, Homo sapiens
MRTALFPTECCLPMCVVLAVFYLPIVFSRIIESADSFD

SEQ ID NO: 3745 - protein, 56 aa, Homo sapiens
MFLASFSSPGFQLSFSSSSNMASAHKSLLCQDLMVLHLPEPSSASVPRPQLVRLTH

SEQ ID NO: 3746 - protein, 56 aa, Homo sapiens
GWFHLFWQEWEQEPGQNKLLEALVLGTAAGRVGTRQNCLQDESQERTLSPVSGVWL

SEQ ID NO: 3747 - protein, 33 aa, Homo sapiens
MVPRSVAFVKTLALLELGFALAVMQGCAEPISM

SEQ ID NO: 3748 - protein, 51 aa, Homo sapiens
AVVPTWCSTVLLTFVPTARLVAGLEDVQVYDGEDAVFSLDLSTIIQGTWFP

SEQ ID NO: 3749 - protein, 10 aa, Homo sapiens
MHLITVLLNV

SEQ ID NO: 3750 - protein, 25 aa, Homo sapiens
MFCLSFPISGAYLLIPAYFLEVVGK

SEQ ID NO: 3751 - protein, 97 aa, Homo sapiens
MEVVVTVTPKTCPLSSLLLFLLYFLVIGSVIHLTAGFRILVLGLVFLFFPYPPYPNCHQVLLHALMISHLSYPSSFQIGPSDFNLGHSHYLLYYGKI

SEQ ID NO: 3752 - protein, 334 aa, Homo sapiens
  SITE (290): Xaa equals any amino acid
  SITE (316): Xaa equals any amino acid
  SITE (321): Xaa equals any amino acid
MLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVKSPEGKFQKTSTGAVRMQPKSAELKFVTKNDGYVHIHPSSVNYQVRHFDSPYLLYHEKIKTSRVFIRDCSMVSVYPLVLFGGGQVNVQLQRGEFVVSLDDGWIRFVAASHQVAELVKELRCELDQLLQDKIKXPSIDLCTCPRGSRIISTIVKLVTTQXKAVLXSACYSPASSSPGK

SEQ ID NO: 3753 - protein, 33 aa, Homo sapiens
MGLLWNLIATYFCFPLDAASTHVDYEVLTHPRS

SEQ ID NO: 3754 - protein, 50 aa, Homo sapiens [sequence omitted]

SEQ ID NO: 3755 - protein, 38 aa, Homo sapiens
MYLKYCYVILGYLFIFEIFVYIAFLNLANNMCKGINQK

SEQ ID NO: 3756 - protein, 5 aa, Homo sapiens
IVGFN

SEQ ID NO: 3757 - protein, 30 aa, Homo sapiens
MLQFSCLSISHVLILLITFFACVVLAPFQK

SEQ ID NO: 3758 - protein, 29 aa, Homo sapiens
MFFSCLFLFGLYSGCLFLFVKRKQCTEKQ

SEQ ID NO: 3759 - protein, 45 aa, Homo sapiens
MELNIAWMTEKLWKEMEDFLNFSLVLFVMKLKLPAPEKVFQYLLC

SEQ ID NO: 3760 - protein, 38 aa, Homo sapiens
  SITE (25): Xaa equals any amino acid
MQTCLLWNLKTLLVVRLLPGIPGLXGFYFDSKQKQMLC

SEQ ID NO: 3761 - protein, 38 aa, Homo sapiens
MVCSILSFSILPFWEDFGISFLFFLFFLREWQIVFSQV

SEQ ID NO: 3762 - protein, 52 aa, Homo sapiens
MCVVNILWFSAFTSMRVASDPARLTGLPKPSLASSTYISLCCSTSKQTKIGV

SEQ ID NO: 3763 - protein, 31 aa, Homo sapiens
MFMLAILLTFFHPFLVYRECRTWKESPSAIA

SEQ ID NO: 3764 - protein, 15 aa, Homo sapiens
YIFVWISSVYVQYFV

SEQ ID NO: 3765 - protein, 40 aa, Homo sapiens [sequence omitted]

SEQ ID NO: 3766 - protein, 45 aa, Homo sapiens
GMAVLVEKSVVLVIWLGPVAQAGSNWFAVSSLQEYLKQGDSSSLL

SEQ ID NO: 3767 - protein, 46 aa, Homo sapiens [sequence omitted]

SEQ ID NO: 3768 - protein, 31 aa, Homo sapiens
MTFVIYYTHWFLLIIVLSDFLFSTMVPLAEK

SEQ ID NO: 3769 - protein, 2 aa, Homo sapiens
KW

SEQ ID NO: 3770 - protein, 33 aa, Homo sapiens
MEKLDWAYSQHSVICKCISLLCRVFLLGVNFDS

SEQ ID NO: 3771 - protein, 32 aa, Homo sapiens
MLTGTLFPGFHVRLWALSPAQAQECLVGGEWS

SEQ ID NO: 3772 - protein, 20 aa, Homo sapiens
MCGCTTFFCDYMGSFERIYL

SEQ ID NO: 3773 - protein, 46 aa, Homo sapiens
MIFLGLHTFALFSEPCPLNVTLLPFSTVCVPTVQGLPGTAHRLMAC

SEQ ID NO: 3774 - protein, 37 aa, Homo sapiens
MYCKQSCVLILFSLFECIIILIIPKTLTTQGTAVQYY

SEQ ID NO: 3775 - protein, 28 aa, Homo sapiens
MHLPQLPLQSHHYCRLALRVSFQVFWHV

SEQ ID NO: 3776 - protein, 32 aa, Homo sapiens
KMNLFVLVGAISFIFRTTECAFINRMKAHAED

SEQ ID NO: 3777 - protein, 41 aa, Homo sapiens
MGHLKSCMNHNLLWYLCTCLILYSLFQCGICAPLYLLRSAE

SEQ ID NO: 3778 - protein, 82 aa, Homo sapiens
LPVEEPNPAKRLLFLLLTIVFCQILMAEEGVPAPLPPEDAPNAASLAPTPVSPVLEPFNLTSEPSDYALDLSTFLQQHPAAF

SEQ ID NO: 3779 - protein, 39 aa, Homo sapiens
MALLLHLTGLKCWGHLWLLCITVHTQVEPVCSFPFDMFF

SEQ ID NO: 3780 - protein, 45 aa, Homo sapiens
MMLLLLWPGLQWKCTGTPNVVNALSSICSGILRVGLWFHALAVCK

SEQ ID NO: 3781 - protein, 1 aa, Homo sapiens
S

SEQ ID NO: 3782 - protein, 30 aa, Homo sapiens
MRKYLMGTVYTFLVLVAGKAWTSPLRNISV

SEQ ID NO: 3783 - protein, 47 aa, Homo sapiens
MHETCFYFAALVLLVLLRKEKEGREFMVRRFLVRRFIVRRSRLGHKK

SEQ ID NO: 3784 - protein, 10 aa, Homo sapiens
HAGRYCVIRA

SEQ ID NO: 3785 - protein, 41 aa, Homo sapiens
LCTLSTILCLFSICLFLPISLPLRKKIGVTFVKVILIVNHL

SEQ ID NO: 3786 - protein, 11 aa, Homo sapiens
LLFASFLCKIL

SEQ ID NO: 3787 - protein, 63 aa, Homo sapiens
MFISWFILFRLYPLSSPFFSQNVLKQISDILSPYYFIQKYFSIPERYSSSKKKTTIPLSHLKS

SEQ ID NO: 3788 - protein, 59 aa, Homo sapiens
MHRWKAFFPGPYPSLHNTPVTPHHGLLSDPHGIPVALCSHTAFLICPPCLSLTHILFQG

SEQ ID NO: 3789 - protein, 10 aa, Homo sapiens
MGCWLLPCFL

SEQ ID NO: 3790 - protein, 39 aa, Homo sapiens
MPAHLCLLPLLLCPSYSQNLYLLSNLHFVLVPLPFPIKE

SEQ ID NO: 3791 - protein, 34 aa, Homo sapiens [sequence omitted]

SEQ ID NO: 3792 - protein, 31 aa, Homo sapiens
MTPGSRVMGTCWGFCFFFFTGWLDPQWQKDP

SEQ ID NO: 3793 - protein, 46 aa, Homo sapiens
MKLLRSAAKLMVLISTQTSYAFGEQCTHLTLFLINSNSGKIPLTYF

SEQ ID NO: 3794 - protein, 36 aa, Homo sapiens
MTGTPAWAHLLLLLLLGSAPQTRLWPPSQCPVTSPE

SEQ ID NO: 3795 - protein, 55 aa, Homo sapiens
MGGILLALIEGVGILLTRYTAQQFRNAPPFLEDPSQLPPKDGTPAPGYPSYQQYH

SEQ ID NO: 3796 - protein, 7 aa, Homo sapiens
MPIWAFV

SEQ ID NO: 3797 - protein, 37 aa, Homo sapiens [sequence omitted]

SEQ ID NO: 3798 - protein, 113 aa, Homo sapiens
SACDTGLAVLLTVFCACVLPPFPPAAAETRPSFHTQISCPVLTPPCHHQPCLEPPALWQQNQTFLWAFKMVLCPPVRSCVLSPKGHAKDWLWEALITNPSTSSLPQAGSNKCI

SEQ ID NO: 3799 - protein, 38 aa, Homo sapiens
MQLRGLSLNPRLLLTLGSLCLGSSAPGFGRQQFPKNKM

SEQ ID NO: 3800 - protein, 162 aa, Homo sapiens
MLVMKWEESIIWHHLVLCANSGLSILLILPCKVNNYYPHFAVEKTEYSDTTLTFLGSKKLSVSLGFELQVNLILKHVLLSIRTVVLLTGHGAHACNSSTLGSQGWQITWTQEFETSPGSMAKPHLNRKYLKVRQVWWHAPVVPATREAEVKGLLEPARWRLH

SEQ ID NO: 3801 - protein, 18 aa, Homo sapiens
MTCLLSGCLFCSREGSAV

SEQ ID NO: 3802 - protein, 30 aa, Homo sapiens
MIFLLIVNYLSFIDYGRDLQNGIHVQWCGE

SEQ ID NO: 3803 - protein, 71 aa, Homo sapiens
ESAPPWLPICPTRSLGLLVQLLALAGSCSAGPRALGQASGVVRTTKPLLSPSTPLDLGPPEPPAGWAYTSS

SEQ ID NO: 3804 - protein, 183 aa, Homo sapiens
MTKSSAVLFILIFSLIFKLEELRAALVLVVLLIAGGLFMFTYKSTQFNVEGFAWCWGPRSSVAFAGPSPRCSCRRLNSASRIPSTPCSTCSHSCSWGSSLSLLYLKVSICPHLRKSSVSRTQGCSCGYLGASSLAGFSPLVWASLSSSWSPEPPASLSPLPAFLRKSALCCWQLICWAIRSAS

SEQ ID NO: 3805 - protein, 24 aa, Homo sapiens
CIECIVLAQFSGSRKKIQARTAGL

SEQ ID NO: 3806 - protein, 38 aa, Homo sapiens
MSFPYWLFYLLLFSLPIRDILGGDGKGWAKEQTLGLGP

SEQ ID NO: 3807 - protein, 35 aa, Homo sapiens
SIYLFLLRAQRLFPNILCLLLFPDLLTGFFLPMNF

SEQ ID NO: 3808 - protein, 15 aa, Homo sapiens
FLFINVQLPLCLASR

SEQ ID NO: 3809 - protein, 2 aa, Homo sapiens
KL

SEQ ID NO: 3810 - protein, 23 aa, Homo sapiens
MFSHNGKGKAALWGLFLLVHESH

SEQ ID NO: 3811 - protein, 33 aa, Homo sapiens
MGPSFFFLFSVAFSIFRVHLALPPNLIKNVSDL

SEQ ID NO: 3812 - protein, 18 aa, Homo sapiens
EKVTRFHNAFLFPNHWYS

SEQ ID NO: 3813 - protein, 20 aa, Homo sapiens
MWWPSWMTSSTGPAGVLCGP

SEQ ID NO: 3814 - protein, 13 aa, Homo sapiens
EFRAGFLLLLHGM

SEQ ID NO: 3815 - protein, 4 aa, Homo sapiens
MNSP

SEQ ID NO: 3816 - protein, 39 aa, Homo sapiens
MLSFRIISSFYIILVFCSYVLRAHTLLGSVSPREKWYEK

SEQ ID NO: 3817 - protein, 8 aa, Homo sapiens
MLFFKLAI

SEQ ID NO: 3818 - protein, 40 aa, Homo sapiens
MLIKKLWFLQDFVFRDSGKEHINQKEELTSILLVLKITDY

SEQ ID NO: 3819 - protein, 62 aa, Homo sapiens
MAMYCGLHGLTVLTKMLPGCMSAWKKLSRNTWVKKISTPRSASIFMSVRWSARVARSVTCTP

SEQ ID NO: 3820 - protein, 36 aa, Homo sapiens
MFNSLLAFFLILWGCITSLKDIVIISYKVKIKKDCV

SEQ ID NO: 3821 - protein, 33 aa, Homo sapiens
  SITE (8): Xaa equals any amino acid
MALILLLXVLMEVTLEGKKKMDGVHMEEMVQKT

SEQ ID NO: 3822 - protein, 26 aa, Homo sapiens
MLVLTFVSVYHLNVFMYLMVFCGCFS

SEQ ID NO: 3823 - protein, 9 aa, Homo sapiens
MVSSPQGLC

SEQ ID NO: 3824 - protein, 17 aa, Homo sapiens
YCIFTFLSTADVTIYGQ

SEQ ID NO: 3825 - protein, 25 aa, Homo sapiens
KLIWQVLLVFLIIIILNPKYSNFLN

SEQ ID NO: 3826 - protein, 18 aa, Homo sapiens
MTGLHMTLLISFIYVSTF

SEQ ID NO: 3827 - protein, 45 aa, Homo sapiens [sequence omitted]

SEQ ID NO: 3828 - protein, 7 aa, Homo sapiens
MTTLQGG

SEQ ID NO: 3829 - protein, 14 aa, Homo sapiens
KPLFLHLPLLTLQA

SEQ ID NO: 3830 - protein, 59 aa, Homo sapiens
MGLSVLLPLCLLGPGRFTSGQKPLDTPGLGAAVLSVRKAGLKMRSHLTPSVCTVPSPGS

SEQ ID NO: 3831 - protein, 34 aa, Homo sapiens
  SITE (24): Xaa equals any amino acid
MLTSLICYAIPCKFLNFAVPWFCXITPGSVTMAT

SEQ ID NO: 3832 - protein, 34 aa, Homo sapiens; identical to SEQ ID NO: 3831
  SITE (24): Xaa equals any amino acid

SEQ ID NO: 3833 - protein, 38 aa, Homo sapiens
MRMIIISYIKICGRFTVMITLLVPTLSLNLHDPVASKN

SEQ ID NO: 3834 - protein, 31 aa, Homo sapiens
MGNLYPKLGLKIIFIFVFQQTWVLCPAMDQK

SEQ ID NO: 3835 - protein, 77 aa, Homo sapiens
VTQSKWLIFYIVVYFVLPSSLRNKARIFSLFDIYSETKGLLDLMIFLQLSEGAFSTIQVILIHTKVENHCTRSLCVF

SEQ ID NO: 3836 - protein, 13 aa, Homo sapiens
MLSVATNRIYNSN

SEQ ID NO: 3837 - protein, 67 aa, Homo sapiens [sequence omitted]

SEQ ID NO: 3838 - protein, 18 aa, Homo sapiens
MCESFPEGFCPCFHMSHN

SEQ ID NO: 3839 - protein, 21 aa, Homo sapiens
MFKVRGFLSICLVFCWQVTCR

SEQ ID NO: 3840 - protein, 47 aa, Homo sapiens
  SITE (17): Xaa equals any amino acid
MFKVRGFLSICLVFCWXGHMQVIGYGKGKMPRLLLGWSPSPKFKPPE

SEQ ID NO: 3841 - protein, 35 aa, Homo sapiens
MSLPLYVSLSDMFYAKLSDFKFKISEIKCPSLHIV

SEQ ID NO: 3842 - protein, 19 aa, Homo sapiens
MLVLVVFCWAVLVYFHPSL

SEQ ID NO: 3843 - protein, 29 aa, Homo sapiens
MMCFLFLNEICLASCMENEFCWSIVETET

SEQ ID NO: 3844 - protein, 36 aa, Homo sapiens
MKMLICSLTLLVCLSPRVGRRSRYYHSKGTESVSTL

SEQ ID NO: 3845 - protein, 18 aa, Homo sapiens
MNMICLSYRLALTCFFFQ

SEQ ID NO: 3846 - protein, 348 aa, Homo sapiens
GTLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 3847 - protein, 34 aa, Homo sapiens
MTITLVAFHLILPSFIIWFTWICHPINSEVYQQN

SEQ ID NO: 3848 - protein, 29 aa, Homo sapiens
FFFFGFFVFFKHQSALSECRVLIGGMMMV

SEQ ID NO: 3849 - protein, 58 aa, Homo sapiens
MQGPGLSAAGGCLWAWLSLGTPFLSVATLAVSGAALDNFGHRNSGGGFWSSEVATQQV

SEQ ID NO: 3850 - protein, 82 aa, Homo sapiens
  SITE (3): Xaa equals any amino acid
  SITE (23): Xaa equals any amino acid
  SITE (72): Xaa equals any amino acid
CSXSYLWQVDYIGPLHYGRDRIXSYWNILTQDMDLPFLHAILLPRVPSMDLQNCLVDCHGITHSIAFDQGTXSTDRNAAMHS

SEQ ID NO: 3851 - protein, 123 aa, Homo sapiens
VARLHRLLHTFLLTFCCLLMAEEAAVFAKYLAHGLPAGAPLRLVFLLNVLLLGLWNFCCSVPSSISTSTLTRWWAPQWAPLPGTSPMAAGIISPGLQGAQAMGSSPVPTPAASITERNKNHRA

SEQ ID NO: 3852 - protein, 72 aa, Homo sapiens
  SITE (38): Xaa equals any amino acid
MSPWDLPRRGLLLLVLPFLLSPRPLVYLLLPALPQLQXLQAHQQTVLSSPLKLQTKPTLQAKLHLGLEMVIS

SEQ ID NO: 3853 - protein, 13 aa, Homo sapiens
YTHTYAHMLWVLP

SEQ ID NO: 3854 - protein, 37 aa, Homo sapiens
MLIRVIIFKSFSQSCISILALSKLVELFSVLLDILHS

SEQ ID NO: 3855 - protein, 37 aa, Homo sapiens
MDIKILPMCFVFYCCSICYCTCDGTCAYIALKQISRS

SEQ ID NO: 3856 - protein, 31 aa, Homo sapiens
MYLFILLYLCFYFSSSENGFLVSEVYLYLKF

SEQ ID NO: 3857 - protein, 20 aa, Homo sapiens
MWPLLFAICVSVAYGLSCIR

SEQ ID NO: 3858 - protein, 20 aa, Homo sapiens
GKCLINLVIGWVKYMGEFYM

SEQ ID NO: 3859 - protein, 20 aa, Homo sapiens
GKCLINLVIGWVKYMGEFYM

SEQ ID NO: 3860 - protein, 82 aa, Homo sapiens
MSCSHTCLYLKPSVCPVVWGEVMDSARWTCCGWMFPACAGPEWTGATSQHVRENHCHTIPMDFVLFLKKKKFFSVNMNFFSM

SEQ ID NO: 3861 - protein, 156 aa, Homo sapiens
MLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 3862 - protein, 31 aa, Homo sapiens [sequence omitted]

SEQ ID NO: 3863 - protein, 17 aa, Homo sapiens
MILVGLWLIQWLLLKYK

SEQ ID NO: 3864 - protein, 4 aa, Homo sapiens
MRSE

SEQ ID NO: 3865 - protein, 126 aa, Homo sapiens [sequence omitted]

SEQ ID NO: 3866 - protein, 39 aa, Homo sapiens
MFSFYSHNPLKPCLVLLLFASAVQDVAPFLLFEHGLVTR

SEQ ID NO: 3867 - protein, 24 aa, Homo sapiens
MCNLYLILYFVIHTNMSRHCDICL

SEQ ID NO: 3868 - protein, 23 aa, Homo sapiens
MPSLHTFFLLLPFVFMPVAFTLH

SEQ ID NO: 3869 - protein, 38 aa, Homo sapiens
  SITE (14): Xaa equals any amino acid
  SITE (21): Xaa equals any amino acid
MAKCITITLFTVIXFAENISXSWNCEIKLKILLVKMTN

SEQ ID NO: 3870 - protein, 38 aa, Homo sapiens
MAKCITITLFTVICFAENISSSWNCEIKLKILLVKMTN

SEQ ID NO: 3871 - protein, 18 aa, Homo sapiens
CLLLSKLLHLQPLAVADS

SEQ ID NO: 3872 - protein, 40 aa, Homo sapiens
MFCTLWIGILVRKSIASRKRLMSQLAGETVPSFWVAVLVK

SEQ ID NO: 3873 - protein, 35 aa, Homo sapiens
MVILLAHPCIHQPGISLNLFASEFLLTFQYIGIID

SEQ ID NO: 3874 - protein, 11 aa, Homo sapiens
MYFSIEGGVFQ

SEQ ID NO: 3875 - protein, 24 aa, Homo sapiens
VCVTVSNPISCLSVAPSHLLDQAA

SEQ ID NO: 3876 - protein, 26 aa, Homo sapiens
MSTIMFSLWTICVGLPPARSLLYPHQ

SEQ ID NO: 3877 - protein, 37 aa, Homo sapiens
MQILHWQWLLCVKYFPFGLIFIHIVSLNKGETTYRRN

SEQ ID NO: 3878 - protein, 39 aa, Homo sapiens
  SITE (16): Xaa equals any amino acid
MTLAFVVLALWPNGRXHVLVHMCWLLFLKSWQCQHMGGI

SEQ ID NO: 3879 - protein, 1 aa, Homo sapiens
L

SEQ ID NO: 3880 - protein, 148 aa, Homo sapiens
MSPRWALVTLLGFSHRKQRCLPLPLLHILPLPSRAGFWVHLSTGRCSQGVGAGGGVCGQVLGGTRKSRGVAHADQAHVAHGAELPRTAHDSATFSPFQPRRDVTLELLWHFCQASPAPIALRSLLFVRDLQRLTFLLFSHHSIVILRN

SEQ ID NO: 3881 - protein, 7 aa, Homo sapiens
MHLVTVC

SEQ ID NO: 3882 - protein, 10 aa, Homo sapiens
MSLCGSRDLC

SEQ ID NO: 3883 - protein, 8 aa, Homo sapiens
MWILLYLI

SEQ ID NO: 3884 - protein, 15 aa, Homo sapiens
MMFLLIFVWYLQPYP

SEQ ID NO: 3885 - protein, 18 aa, Homo sapiens
MQLWLKSGLLLSFILILP

SEQ ID NO: 3886 - protein, 7 aa, Homo sapiens
LGFLLLT

SEQ ID NO: 3887 - protein, 77 aa, Homo sapiens
MIRMLVLSLLLTFYLLSIWSIAFFLACQAARIFRDHLVQSLIRCLHPHTYVPSKGSAFDIVFILHLFSLSRDSERAE

SEQ ID NO: 3888 - protein, 37 aa, Homo sapiens
MSLSLIYFSVSFTTFGVKSSHDLYIPRLLLLKILYIL

SEQ ID NO: 3889 - protein, 62 aa, Homo sapiens
RGRGRLLGLSSFLCIILGLAWTAPASESCGPHPLAAEPSTVILGAIFPCRTGSLSPAPTFGL

SEQ ID NO: 3890 - protein, 62 aa, Homo sapiens; identical to SEQ ID NO: 3889

SEQ ID NO: 3891 - protein, 42 aa, Homo sapiens
MAAPSFLTSFLLPSSLPQVLSRETPFPAISSGRLGRCWADTS

SEQ ID NO: 3892 - protein, 48 aa, Homo sapiens
  SITE (46): Xaa equals any amino acid
MVAVWWFSLVMLFESFLLCVSALPVSFIFSYIFMMVDIVLLLPNVXLP

SEQ ID NO: 3893 - protein, 11 aa, Homo sapiens
MLLGISAVGLF

SEQ ID NO: 3894 - protein, 40 aa, Homo sapiens
GILLVQTYLGCCWGRHLGFSVSCIHRGRPFQIQEHWIRES

SEQ ID NO: 3895 - protein, 36 aa, Homo sapiens
MPSPLLSSVNTNTFPTPLCSRRPVAGRFSVPVVWIL

SEQ ID NO: 3896 - protein, 28 aa, Homo sapiens
MNDPPTAPHGLFLFLWLFSLRSGGFTRI

SEQ ID NO: 3897 - protein, 46 aa, Homo sapiens
VYVHTLCFVCVWFGAACVCVCVCVCDICYACVCQCVLGVPAPLSWR

SEQ ID NO: 3898 - protein, 119 aa, Homo sapiens
  SITE (51): Xaa equals any amino acid
  SITE (59): Xaa equals any amino acid
  SITE (68): Xaa equals any amino acid
MGSALGLAGISGSLGSGARLRWARSRTQGAGLWGVLAAGAVSGESQSCRAXKEREGAVXAMPPVGQQXNRQALPAHPPTHLGVHPPHWAWPRQVSLPGPGPAQPASLFLLPPHSPGTGL

SEQ ID NO: 3899 - protein, 65 aa, Homo sapiens
MWGRRQCALWMVFTSTAHTTLGSRPSTKQESARTARPWSSKRLRWPGLLSTLARRTRTSSSPMTT

SEQ ID NO: 3900 - protein, 4 aa, Homo sapiens
MFLI

SEQ ID NO: 3901 - protein, 17 aa, Homo sapiens
MFLFCIFSSPSPLTQRI

SEQ ID NO: 3902 - protein, 37 aa, Homo sapiens
MLIGLLSLAPDSACSWLPVLTDHICHCHRISSASASA

SEQ ID NO: 3903 - protein, 55 aa, Homo sapiens
MAGTRPTGKRCWSIWVTLLITRCPFDLAGPASLLMRSLCWPPCSTRSLPSVPAVS

SEQ ID NO: 3904 - protein, 33 aa, Homo sapiens
MARGGTWWSLLSFWTWGCQTRAHPHTRPGPLRP

SEQ ID NO: 3905 - protein, 8 aa, Homo sapiens
MHYLQTGG

SEQ ID NO: 3906 - protein, 8 aa, Homo sapiens
MHYLQTGG

SEQ ID NO: 3907 - protein, 24 aa, Homo sapiens
MVSHGCHVPLFALFMVLPSSQGLP

SEQ ID NO: 3908 - protein, 36 aa, Homo sapiens
MPLFGGNLGYAWAWFTPITWVAVLAHLIVSSIHPGK

SEQ ID NO: 3909 - protein, 41 aa, Homo sapiens
MARVSARWRSLLAWWVSSCPISLEGRAGSHEHGEYPWMLHS

SEQ ID NO: 3910 - protein, 33 aa, Homo sapiens
  SITE (25): Xaa equals any amino acid
FLFWGVMKILGCAPIFSFLRLSLIXDRHLGVVF

SEQ ID NO: 3911 - protein, 123 aa, Homo sapiens
MAFLSFCCCAFALYYWSSAFSLSIVFFFLYRIYTPKFFHLASSHNLTSPSGSCPVFLLLFILSLKGRVYSHYLHFSTCHLAFHPLQPEFDPQNSTETTLSKATNYCLIVKVNGLFFIFIIYGI

SEQ ID NO: 3912 - protein, 37 aa, Homo sapiens
MNIVWFVMSHMCFKMALCLGLPYVNGSCVCLLFKPWE

SEQ ID NO: 3913 - protein, 16 aa, Homo sapiens
MFLDFLFCPVGLFVSL

SEQ ID NO: 3914 - protein, 182 aa, Homo sapiens
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEETTTSSRWLRKNWPRRWNPTRRTGRPTSPPCWNGCKRRTSTPRRCGKTRS

SEQ ID NO: 3915 - protein, 120 aa, Homo sapiens
ATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 3916 - protein, 36 aa, Homo sapiens
MRNALHSMNINFHLPFFLVFILLFILLLIHDSYTYL

SEQ ID NO: 3917 - protein, 15 aa, Homo sapiens
MISDTEPFFLWLLAA

SEQ ID NO: 3918 - protein, 48 aa, Homo sapiens
GTPSLLPYSCSRFSGLNQVNRGPEPPLCLLEIPKTEMCSRSRSKTLSL

SEQ ID NO: 3919 - protein, 37 aa, Homo sapiens
MRSLGSTLVSDTWDRGAFATLVVVTPPHLPASFTDSK

SEQ ID NO: 3920 - protein, 40 aa, Homo sapiens
MCKMFNLPFLLLVSVALWCKQLKTLNVYTIRPRRQMKYFF

SEQ ID NO: 3921 - protein, 36 aa, Homo sapiens
MTNLVISFTLRFSSFPVLPFCLLLCNIAFGLNNTFS

SEQ ID NO: 3922 - protein, 39 aa, Homo sapiens
MTRPTIVSSCLWAVRQLVGTRSNPRFFLQYSGYNLSWLL

SEQ ID NO: 3923 - protein, 182 aa, Homo sapiens
MAALAHEAVGTRDLLAAGCCCLARWGSMEELGLPPRPAPAARMLGSHGGTRPGAPASPSGWCGQLFPASQCPGGSCLADSAWSPAGFRKTQLHVWDSSPALGCGVSVHLRAGGPTHRLPLQVHPRAWARWAPGTWPADAATSDQCCVEEPRAAPGKPGFNSTRKRNLLCFVRACSFSSFLSL

SEQ ID NO: 3924 - protein, 142 aa, Homo sapiens
  SITE (2): Xaa equals any amino acid
MXALAHEAVGTRDLLAAGCCCLARWGSMEELGLPPRPAPAARMLGSHGGTRPGAPASPSGWCGQLFPASQCPGGSCLADSAWSPAGFRKTQLHVWDSSPALGCGVSVHLRAGGPTHRLPLQVHPRAWGPLGTWHLACRCCYE

SEQ ID NO: 3925 - protein, 35 aa, Homo sapiens
MLRVFFFSLVVGTSTARTISYSSLHPWHMHENIST

SEQ ID NO: 3926 - protein, 57 aa, Homo sapiens
MYWCTYCMEAWLSSQQLVLHRNMRPCIFQMFSLSRLFTMESTTSCTHSCCSSAMASP

SEQ ID NO: 3927 - protein, 27 aa, Homo sapiens
MPASLRNPTVLHMLSNTIFSYPLSLPC

SEQ ID NO: 3928 - protein, 40 aa, Homo sapiens
GCHHLFLYIFCNILKLLPSLIIISVCVCKDNQAFKFIKHV

SEQ ID NO: 3929 - protein, 244 aa, Homo sapiens
  SITE (78): Xaa equals any amino acid
  SITE (222): Xaa equals any amino acid
MHLALYCFASSQLSTALSLLYRARYLMLLVFGEDHPEMALLDNNIGLVLHGVMEYDLSLRFLENALAVSTKYHGPKAXKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPXGAPGDLGSQPPAAKDPSPSVQG

SEQ ID NO: 3930 - protein, 48 aa, Homo sapiens
HLQHCVSCGCAVTGIKSSAFNAKGSEIFLKLISCPMQVFSTTCITSTL

SEQ ID NO: 3931 - protein, 71 aa, Homo sapiens [sequence omitted]

SEQ ID NO: 3932 - protein, 44 aa, Homo sapiens
DLQIQWPILLSLSCEGVFQVLKQSKNHLGPSLRKHFSGQVGFRL

SEQ ID NO: 3933 - protein, 14 aa, Homo sapiens
GFYTFLPSLPGALY

SEQ ID NO: 3934 - protein, 139 aa, Homo sapiens
MKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGVLGTAYLEGCKTSITLAATVLRSPWSLAVRSSHLKRL

SEQ ID NO: 3935 - protein, 2 aa, Homo sapiens
MY

SEQ ID NO: 3936 - protein, 9 aa, Homo sapiens
MRFLFIFCF

SEQ ID NO: 3937 - protein, 12 aa, Homo sapiens
MERVRTSMECFC

SEQ ID NO: 3938 - protein, 48 aa, Homo sapiens
MLVILLDMFFVVVVTWNFCILNKFGDQIQKKKKKKKKKKKKKKKKKKK

SEQ ID NO: 3939 - protein, 31 aa, Homo sapiens
MVIWSTYDTLAVLIFGVLALVLSHLHVWVFL

SEQ ID NO: 3940 - protein, 48 aa, Homo sapiens
ELSCWQDLLELARQLWLWLLLRSWVVRSPSAQWWGVKFTQLRSRRQRC

SEQ ID NO: 3941 - protein, 59 aa, Homo sapiens [sequence omitted]

SEQ ID NO: 3942 - protein, 1 aa, Homo sapiens
F

SEQ ID NO: 3943 - protein, 44 aa, Homo sapiens
MSGLSGAPWGTWALPLAHLSLLSRTCLSSSPLGFRLFSRHLRHL

SEQ ID NO: 3944 - protein, 38 aa, Homo sapiens
MLSLPAPLRVNRGLWQLCTGAGLWLLQGALPVTRSWAV

SEQ ID NO: 3945 - protein, 40 aa, Homo sapiens
MAGVSTSPGPFLRYLPACLPELTCRPRKMLTEVLLEVAPA

SEQ ID NO: 3946 - protein, 133 aa, Homo sapiens
MFTDLSSSWCMTMTPVGSMTSSASSPALSRRCRKGRQTLGRRCSGTVSTQVSGQEEELQELRDGSAGPVHGGEGAHLPGLHHGWLPDQLHGGHRLHRLQWGPEEQPVPALPQSPTAQPLPAGPACSGRHLPGL

SEQ ID NO: 3947 - protein, 8 aa, Homo sapiens
WAFSAWLL

SEQ ID NO: 3948 - protein, 9 aa, Homo sapiens
IFLILLICV

SEQ ID NO: 3949 - protein, 29 aa, Homo sapiens
RVFLNHELYHVTFLLVKLSVALHCQQSPA

SEQ ID NO: 3950 - protein, 90 aa, Homo sapiens
MADRAPRQPTSLGSSPQRCGSPPSAPPPPPDRGERIEDCLAPLCPPVVGGRGGCALSRFLPVDLSLLRSSRTAAVELVAGGVCRSPSQEN

SEQ ID NO: 3951 - protein, 42 aa, Homo sapiens
IIVRVGFALSCSVSCPFFALLSCDAFHHIMTQQEGPHKVPAP

SEQ ID NO: 3952 - protein, 42 aa, Homo sapiens
MKIFMYVPIILFRSQCLCLSLTEIIELLSSSKLNKTLELKAS

SEQ ID NO: 3953 - protein, 6 aa, Homo sapiens
GVSLHQ

SEQ ID NO: 3954 - protein, 66 aa, Homo sapiens
MGSRLAPLLSACLFVSVILGRMVILKNPGVLGQRQAGPSPGAPGLPSPSVRAPLGHKCSERSPSAT

SEQ ID NO: 3955 - protein, 87 aa, Homo sapiens [sequence omitted]

SEQ ID NO: 3956 - protein, 22 aa, Homo sapiens
MLMPPPPPARLFFLYFVLFLLG

SEQ ID NO: 3957 - protein, 46 aa, Homo sapiens
MRLGISELSFLLGALGYLSLPRVGPLEPFLPWVGAVSGCWEGLCWP

SEQ ID NO: 3958 - protein, 51 aa, Homo sapiens
MTTSQAISCLAHWACAWETACCWMARRRAHCGSVGPRSLPAAVGGRGAGRT

SEQ ID NO: 3959 - protein, 66 aa, Homo sapiens [sequence omitted]

SEQ ID NO: 3960 - protein, 66 aa, Homo sapiens [sequence omitted]

SEQ ID NO: 3961 - protein, 66 aa, Homo sapiens [sequence omitted]

SEQ ID NO: 3962 - protein, 22 aa, Homo sapiens
MVCCWRGCCWSWSIVLLWLGTV

SEQ ID NO: 3963 - protein, 60 aa, Homo sapiens
MKNSLAAQQSFSACSQIGEVSTCYSLCRRPSFLLCFPSLVFPPAGSWAGVPGCLPESRLH

SEQ ID NO: 3964 - protein, 60 aa, Homo sapiens; identical to SEQ ID NO: 3963

SEQ ID NO: 3965 - protein, 76 aa, Homo sapiens
VGHHSRPWTSPNLGTALFPNVSILLTGASSAQPWEPIQGLVRTGLPGVGVWGVPSGVIDSPTAPALTGPQVAAMVN

SEQ ID NO: 3966 - protein, 32 aa, Homo sapiens
WALALATHFLQNLGFGKNMASRQSKLSRQWGW

SEQ ID NO: 3967 - protein, 29 aa, Homo sapiens
MELLFFLLLPYFLLFICLISCISQIYIYL

SEQ ID NO: 3968 - protein, 64 aa, Homo sapiens
MPSFIIHSNPIWLGALLWVSHCPSSILGSLRPRGGKIQLRVGGSEPRRIMKATCFGNDLPLPVV

SEQ ID NO: 3969 - protein, 39 aa, Homo sapiens
MAGKASLTSSASVIAWPSLLCLLLLWMPVIGFCAYHTPM

SEQ ID NO: 3970 - protein, 129 aa, Homo sapiens [sequence omitted]

SEQ ID NO: 3971 - protein, 66 aa, Homo sapiens
MCCPSLLKFYFRFSIGYLFCFLYFFSLSLPPSRPPRPIPFLPLDFHPLGCLAHLYAPALGTGPNTW

SEQ ID NO: 3972 - protein, 55 aa, Homo sapiens
MSVGLSSSFLILFMPCQVYCLYPLVNFFISVIIRLKKKKKKKKESSLLGNAWTLC

SEQ ID NO: 3973 - protein, 46 aa, Homo sapiens
  SITE (13): Xaa equals any amino acid
MHLIIFFLSLLCXFLKLPPKYLSTPLNVWSQDKFLILALQFKMYKK

SEQ ID NO: 3974 - protein, 1 aa, Homo sapiens
L

SEQ ID NO: 3975 - protein, 40 aa, Homo sapiens [sequence omitted]

SEQ ID NO: 3976 - protein, 34 aa, Homo sapiens
LELTVLSSLRTFEYTLPISLPYFLFAAFALELCF

SEQ ID NO: 3977 - protein, 21 aa, Homo sapiens
DCPARAAPQPADLTAAPASVA

SEQ ID NO: 3978 - protein, 35 aa, Homo sapiens
MTMKLSVFLSVQNLGLLSVVLKRALALSTPSLEIC

SEQ ID NO: 3979 - protein, 1 aa, Homo sapiens
M

SEQ ID NO: 3980 - protein, 28 aa, Homo sapiens
MVLFNAHGCFLICGLLVSRAMHNVSEGS

SEQ ID NO: 3981 - protein, 4 aa, Homo sapiens
FGFV

SEQ ID NO: 3982 - protein, 1 aa, Homo sapiens
M

SEQ ID NO: 3983 - protein, 17 aa, Homo sapiens
MVGLWFVFSLYSLVTFL

SEQ ID NO: 3984 - protein, 38 aa, Homo sapiens
MLGCLLVVFLCCLILGKLLCKAKNPVNTILSFTGRHYW

SEQ ID NO: 3985 - protein, 13 aa, Homo sapiens
GNSLTLAILLLSF

SEQ ID NO: 3986 - protein, 59 aa, Homo sapiens
MWRLAPRRLRQVHAKPAWLSSGFLLTRWMPVPRPPDRALQHWRGLWWGPRCRTGTASAH

SEQ ID NO: 3987 - protein, 670 aa, Homo sapiens
DCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVRRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 3988 - protein, 45 aa, Homo sapiens
MFFSQLNCCISQTLGSMKAGRGNLNINYEHKFEGKKTKNHYLIKL

SEQ ID NO: 3989 - protein, 27 aa, Homo sapiens
MVVHILWSWCCRGLAGTAALPRVLFYF

SEQ ID NO: 3990 - protein, 56 aa, Homo sapiens
MGPHWGREASCFLWFPAGQSCPPFPVLPTLGNREGRRGEEREDPGGLGRSSLKRLL

SEQ ID NO: 3991 - protein, 60 aa, Homo sapiens
MMSFVWSRVPYCILLWCFLHLCQPVTVSWSLSFMTLTLWKSPGQLFYRIFPSFSLFNVFT

SEQ ID NO: 3992 - protein, 61 aa, Homo sapiens
MLVVSKASHFTLFLNCLFLKICLKKILRWQHIQVATEGGVTSDKLTSMSLANLDFWSQAPD

SEQ ID NO: 3993 - protein, 31 aa, Homo sapiens
MPCRMDRMTDRDEAETSTDPSHQVEPFFFLF

SEQ ID NO: 3994 - protein, 15 aa, Homo sapiens
MTRAILCLLLCCPGH

SEQ ID NO: 3995 - protein, 6 aa, Homo sapiens
MKILVL

SEQ ID NO: 3996 - protein, 149 aa, Homo sapiens
MAYTLLGLLWLHRGGAVGLGPRYLKDVFAAMALLYGPVQWLRLWTQWRRAAVLDQWLTLPIFAWPVAWCLYLNRGWRPWLFLSLECVSLASYGLSLCIPRGFEVALGAHMWPLWGRRCAPNRHYGNTTSATYSPLGVPLLPGLCGPQAV

SEQ ID NO: 3997 - protein, 23 aa, Homo sapiens
MKLNNKQCHLYMGTMPSSSCCVF

SEQ ID NO: 3998 - protein, 58 aa, Homo sapiens
LQLGLCCLPVLFVALGMASDPIFTLAPPLHCHYGAFPPNASGWEQPPNASGVTSPALP

SEQ ID NO: 3999 - protein, 60 aa, Homo sapiens
MAVTALAARTWLGVWGVRTMQARGFGSDQSENVDRGAGSIREAGGAFGKREQAEEERYFR

SEQ ID NO: 4000 - protein, 53 aa, Homo sapiens
VLSCILALLVKHSKASTHPPFSPLGKAVDCNIHTAPWAMVKSLAEGLGEALCV

SEQ ID NO: 4001 - protein, 35 aa, Homo sapiens
MCPLTTASEALSAIKMQILGLILLLLNPGISGGNS

SEQ ID NO: 4002 - protein, 38 aa, Homo sapiens
MRSEGGRLIKTTKNIIVVTLLFFFFCGGGDSTIIKIQT

SEQ ID NO: 4003 - protein, 38 aa, Homo sapiens; identical to SEQ ID NO: 4002

SEQ ID NO: 4004 - protein, 27 aa, Homo sapiens
MYLDQSSLVFLTLAMSHCHLMGPIWVL

SEQ ID NO: 4005 - protein, 32 aa, Homo sapiens
MTGRQSLRPGCALLLLPSVFSQLLSLGAPGSE

SEQ ID NO: 4006 - protein, 59 aa, Homo sapiens [sequence omitted]

SEQ ID NO: 4007 - protein, 40 aa, Homo sapiens
MVLLRVLASHLHHFYFSFTICIFQSAYILTLLLVVLMTSD

SEQ ID NO: 4008 - protein, 2 aa, Homo sapiens
WN

SEQ ID NO: 4009 - protein, 28 aa, Homo sapiens
MTLAFVTLVRVISTIIGGMADQGEVKSQ

SEQ ID NO: 4010 - protein, 8 aa, Homo sapiens
MCRWFVSE

SEQ ID NO: 4011 - protein, 20 aa, Homo sapiens
MFSQLLLYCVYLYCCRGGCF

SEQ ID NO: 4012 - protein, 40 aa, Homo sapiens
MELKKNVFSVSSLCTPSHYSSHTLHFFFFFKAALIGCYIL

SEQ ID NO: 4013 - protein, 4 aa, Homo sapiens
  SITE (2): Xaa equals any amino acid
MXSY

SEQ ID NO: 4014 - protein, 38 aa, Homo sapiens
MVARCFLTFLRVNSLSQGTVEMGVWSGFPPQSLLITAQ

SEQ ID NO: 4015 - protein, 1 aa, Homo sapiens
I

SEQ ID NO: 4016 - protein, 65 aa, Homo sapiens
MRFFLFPYYCFILSCHSKLTFFGMFFLYLCPFRSALDSLGGLLQWVCLNIVIPHVADWETLLFNW

SEQ ID NO: 4017 - protein, 40 aa, Homo sapiens
MLSLSSLSRCKLYVYWLCSLILFHGKYKQFSAYKYWKKLS

SEQ ID NO: 4018 - protein, 15 aa, Homo sapiens
MFVDVSWFLVFTLLP

SEQ ID NO: 4019 - protein, 39 aa, Homo sapiens
MSHFSCVILILTGIRWHGLVFSQFQNIFLHCFNVKKMKI

SEQ ID NO: 4020 - protein, 3 aa, Homo sapiens
LLG

SEQ ID NO: 4021 - protein, 36 aa, Homo sapiens
MKLFLPRPLSAARVRGLLFCIFIALRHLVLCDYHTY

SEQ ID NO: 4022 - protein, 295 aa, Homo sapiens
MASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 4023 - protein, 36 aa, Homo sapiens
MQPPISSYSFLVFWLTVQPCGFCAASSARKIKPSFS

SEQ ID NO: 4024 - protein, 37 aa, Homo sapiens
MLLLSTLYLPSALSRKTFVLLKTKDVFILDPEERSLL

SEQ ID NO: 4025 - protein, 34 aa, Homo sapiens
MGQGSHLMLVFLILYYIVLFMIQLILTKFVAVEP

SEQ ID NO: 4026 - protein, 34 aa, Homo sapiens
MVFTCPHQKPALSRLLRLLLLNRSAICIPGAPQG

SEQ ID NO: 4027 - protein, 6 aa, Homo sapiens
SWLPPI

SEQ ID NO: 4028 - protein, 16 aa, Homo sapiens
VIISSVFSFVLLSCIH

SEQ ID NO: 4029 - protein, 319 aa, Homo sapiens
MQTCPLAFPGHVSQALGTLLFLAASLSAQNEGWDSPICTEGVVSVSWGENTVMSCNISNAFSHVNIKLRAHGQESAIFNEVAPGSGRRGTAGDQRRPGLRAGAQQGLSRASAELWTPDSEPTPRPLALVFKPSPLGALELLSPQPLFHMPQTHSRLQGREDTGEPALSADLGWRGLGLSSHPEGTDTGLLGRLGLCVTHSWVRADPSPPPPRSSKLCFLSFQNGTTSPPQHPTYQDACPSLCPHQTHRPGLPFCHPRLVRPQVWGPLSPLPGLRAQVRGPLPEPQTHSSSGLWGALATYLSLGYEQALGALPRQPRGPR

SEQ ID NO: 4030 - protein, 30 aa, Homo sapiens
MSISVFSLLLSFLIDGSFSLLPRGCQNFAS

SEQ ID NO: 4031 - protein, 60 aa, Homo sapiens
FYSFFLPHKGLVLFNYTGASSSFLFPSSELPAEILPQLIDKKILIPRSEFRNILINESSC

SEQ ID NO: 4032 - protein, 49 aa, Homo sapiens
MSLTQEPRGRQRRTKVINLHLFLFLFFFFFSSVVTSFPLSFFILPGPLP

SEQ ID NO: 4033 - protein, 8 aa, Homo sapiens
MTTWPTCS

SEQ ID NO: 4034 - protein, 158 aa, Homo sapiens
MGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQHSPGAWWHTMVTATTSPCSKQSWLCWASPVLWMVPSVWIASLR

SEQ ID NO: 4035 - protein, 42 aa, Homo sapiens
MAVAAWVMSVSLHLGFPWALSRQRHPQSHHHCESFGSFSIWA

SEQ ID NO: 4036 - protein, 22 aa, Homo sapiens
LAVLLPQRVLLSVFLCLLPLQR

SEQ ID NO: 4037 - protein, 94 aa, Homo sapiens [sequence omitted]

SEQ ID NO: 4038 - protein, 32 aa, Homo sapiens
MPIKIYFLLVISTLFLILTFITGNVPVHVGSR

SEQ ID NO: 4039 - protein, 28 aa, Homo sapiens
MDFLLFLSGSSSFLSLFLFIYLFIYFAV

SEQ ID NO: 4040 - protein, 49 aa, Homo sapiens
MGALCVHCCILAFCTYGSGISLFPYLLICLRGRNIHYAMTIPVLVNVPV

SEQ ID NO: 4041 - protein, 31 aa, Homo sapiens
MYKEIPVKLFCLMFYWTKVVVCMECSSSVYR

SEQ ID NO: 4042 - protein, 25 aa, Homo sapiens
RKWWPQDIHLTVAVATLWSSSGHQW

SEQ ID NO: 4043 - protein, 46 aa, Homo sapiens
  SITE (36): Xaa equals any amino acid
MNVTVTLPKYHLALIWLLFHFGWALLSVCSKTVLMXLSNVHNAVIG

SEQ ID NO: 4044 - protein, 49 aa, Homo sapiens
MVLVTWPLFTAPFASTSCCAGLEVATMACFKEGNSGTVAPSGVEDSELP

SEQ ID NO: 4045 - protein, 34 aa, Homo sapiens
MCVTFLSACCIYAFYLLLFSLFIQVTKRMLEQAW

SEQ ID NO: 4046 - protein, 31 aa, Homo sapiens
MKPHLHLPLLFLPTLSNITFTLNFSVYRKEN

SEQ ID NO: 4047 - protein, 32 aa, Homo sapiens
MIQHVVFCVWLLSFSIFKLHLSSSLCRYCIAG

SEQ ID NO: 4048 - protein, 216 aa, Homo sapiens
  SITE (101): Xaa equals any amino acid
MEMRSVLRKAGSPRKARRARLNPLVLLLDAALTGELEVVQQAVKEMNDPSQPNEEGITALHNAICGANYSIVDFLITAGANVNSPDSHGWTPLHCAASCNXTVICMALVQHGAAIFATTLSDGATAFEKCDPYREGYADCATYLADVEQSMGLMNSGAVYALWDYSAEFGDELSFREGESVTVLRRDGPERPTGGGPRCTARRATCRGTTSGCSPG

SEQ ID NO: 4049 - protein, 36 aa, Homo sapiens
MLLWLWSGPGMAVGPCRGVALLARSGMCSAEAVNSW

SEQ ID NO: 4050 - protein, 59 aa, Homo sapiens
MCVCVYVCACLCPRPCVPHTAPLSSVLPRDPSELACGAREAPWMGGGATGRLEGLHQAH

SEQ ID NO: 4051 - protein, 55 aa, Homo sapiens [sequence omitted]

SEQ ID NO: 4052 - protein, 347 aa, Homo sapiens
MFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHISWRRPWAPGPLQGHTPGPGQRRGDHRCESEPDPTAPFNVHLQTKLVLLERLPRPS

SEQ ID NO: 4053 - protein, 28 aa, Homo sapiens
PFALSLQRVPFVLPSPQVASLPLGHSRG

SEQ ID NO: 4054 - protein, 410 aa, Homo sapiens
  SITE (83): Xaa equals any amino acid
MADSSGRGAGKPATGPTNSSSAKKKDKRVQGGRVIESRYLQYEKKTTQKAPAGDGSQTRGKMSEGGRKSSLLQKSKADSSGVXKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 4055 - protein, 66 aa, Homo sapiens
MFCWCGLCTSGMVTTGGSPQKHSFFYTSSQGHVSCPSLPGCGQKVICSWPSGGGGGPESEEMAQGQ

SEQ ID NO: 4056 - protein, 66 aa, Homo sapiens; identical to SEQ ID NO: 4055

SEQ ID NO: 4057 - protein, 29 aa, Homo sapiens
GFLGILYLTIFILYQTHLQFLGLLVKTFF

SEQ ID NO: 4058 - protein, 83 aa, Homo sapiens
PPDSRKVLRLNGVSSVYAALALHLRVPGRHLSLGFIFHGDMTCWLKHYSVLFLVGTGTELELFWSVPSYLKMLCCTIILKNYK

SEQ ID NO: 4059 - protein, 61 aa, Homo sapiens [sequence omitted]

SEQ ID NO: 4060 - protein, 36 aa, Homo sapiens
CVCVFICFLPSQFFSPLPTTTMTPSRETINVPIMFV

SEQ ID NO: 4061 - protein, 61 aa, Homo sapiens
MTIMFPQLFYFPTSFAVLSVAGRRKCCWLAQKKLLLLRLLLLSAISVTIETGAVYARGAGS

SEQ ID NO: 4062 - protein, 7 aa, Homo sapiens
MGCIIAT

SEQ ID NO: 4063 - protein, 11 aa, Homo sapiens
MFSPHMYICHM

SEQ ID NO: 4064 - protein, 16 aa, Homo sapiens
MRMCVCTSLSLCGMCV

SEQ ID NO: 4065 - protein, 47 aa, Homo sapiens
MSSRPVLWLMLLVGWMWIKKLCNTGGTQMCLGLGTAPTFLRQRPLLQ

SEQ ID NO: 4066 - protein, 31 aa, Homo sapiens
MTSAFLIHLTLVLVPTVNKTQTLGSKISCSR

SEQ ID NO: 4067 - protein, 8 aa, Homo sapiens
SWLKKLYF

SEQ ID NO: 4068 - protein, 42 aa, Homo sapiens
MEVLQSVLLLLLFSSLISSVFLISVVISGQLMAAQGTGICLA

SEQ ID NO: 4069 - protein, 19 aa, Homo sapiens
MFTLLFFLVTYILITGMLK

SEQ ID NO: 4070 - protein, 39 aa, Homo sapiens
MLQLFLASFIVLLQILIPFVLVMCAFEAVQLTTQLSSKR

SEQ ID NO: 4071 - protein, 305 aa, Homo sapiens
MESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPI

SEQ ID NO: 4072 - protein, 4 aa, Homo sapiens
MVCA

SEQ ID NO: 4073 - protein, 21 aa, Homo sapiens
MYFIPLLHIGQIAMCMHILFS

SEQ ID NO: 4074 - protein, 21 aa, Homo sapiens
MYFIPLLHIGQIAMCMHILFS

SEQ ID NO: 4075 - protein, 25 aa, Homo sapiens
MKGADKSSTLILCFLSVLPCCHLHG

SEQ ID NO: 4076 - protein, 25 aa, Homo sapiens
MKGADKSSTLILCFLSVLPCCHLHG

SEQ ID NO: 4077 - protein, 39 aa, Homo sapiens
  SITE (2): Xaa equals any amino acid
MXHLGLWGVILKLVVPGNHGPLALINPSFNGLLHPDTKV

SEQ ID NO: 4078 - protein, 9 aa, Homo sapiens
MEFLSLELA

SEQ ID NO: 4079 - protein, 44 aa, Homo sapiens
MIRLSAMLLVEMHVNLPASLSVFLDSGQLKSPNTFTFATQRGSS

SEQ ID NO: 4080 - protein, 39 aa, Homo sapiens
MVFIFLLSILFVSALVFITSFLLLALDLACSSLFRFLVV

SEQ ID NO: 4081 - protein, 46 aa, Homo sapiens
MDGWHEILKKILLLFQKCHSSPLKVQETWLSSVVYGGAWASESGQR

SEQ ID NO: 4082 - protein, 95 aa, Homo sapiens [sequence omitted]

SEQ ID NO: 4083 - protein, 194 aa, Homo sapiens
MLAAVGRPKPRSPLSSLSTLQLYLFCSSTRRADMDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPVPTSDRTTSRTSSSSSSDSSTNLHSPNPSDDGADTPLAQSDEEEERGDGGAEPGACS

SEQ ID NO: 4084 - protein, 22 aa, Homo sapiens
MGVRSRAWAFLTFTSTLATRSR

SEQ ID NO: 4085 - protein, 58 aa, Homo sapiens
MPGVGWAQALKSPFCLVVLHLALPGLWCRLGVDLSSVIYVCCLAPRWLCGQVLAKDII

SEQ ID NO: 4086 - protein, 58 aa, Homo sapiens; identical to SEQ ID NO: 4085

SEQ ID NO: 4087 - protein, 58 aa, Homo sapiens; identical to SEQ ID NO: 4085

SEQ ID NO: 4088 - protein, 443 aa, Homo sapiens
MAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 4089 - protein, 31 aa, Homo sapiens
MKIPLYWRSHEMGLSYTCLLWHAIWQQGWGG

SEQ ID NO: 4090 - protein, 31 aa, Homo sapiens
MLLPLCWSSSYSIFIFWATERDSCLEKKKKK

SEQ ID NO: 4091 - protein, 32 aa, Homo sapiens
LIVLLVVFLPQSSDSSSAPRTQDAGIASGPGN

SEQ ID NO: 4092 - protein, 51 aa, Homo sapiens
MPGRRPPLAMWQPLLLCLTSAFQRAPILLSHKINLMPSGKKKKKKKKKKKK

SEQ ID NO: 4093 - protein, 37 aa, Homo sapiens
MPRPACLLIFISGHTLLALPVCPAPAHAPPPRAASVL

SEQ ID NO: 4094 - protein, 59 aa, Homo sapiens
MTRLLVALLFSSFLKLREVESISKIKNKMSKRQDLRTGWACSNMTACTLWGKIYWSSQV

SEQ ID NO: 4095 - protein, 39 aa, Homo sapiens
KAALSGSEIMCHFWWVAGPAIANYHKQKCILLYNSGGKV

SEQ ID NO: 4096 - protein, 120 aa, Homo sapiens
QGRVVPVHLVLLPGVLIPHGPPMCGPDPKYPQDNHEHQEADAHHDHNCRSAGDDCGRMRGRDARSLGPEGHCALDLLGCAWSKRAGQHASAEPTGQEEIPGKARHGPPTWLGHVLLHSCG

SEQ ID NO: 4097 - protein, 45 aa, Homo sapiens
  SITE (36): Xaa equals any amino acid
  SITE (37): Xaa equals any amino acid
  SITE (41): Xaa equals any amino acid
MFLQQLWWQLSLRNLWCVVGSYQNKKCRHFPFFWGXXVGGXALPS

SEQ ID NO: 4098 - protein, 20 aa, Homo sapiens
MACFLAVVMWVFLPVGSCPL

SEQ ID NO: 4099 - protein, 44 aa, Homo sapiens [sequence omitted]

SEQ ID NO: 4100 - protein, 35 aa, Homo sapiens
MALNTISHQIYLPPGPLPCPWASCILLPTCTYVWT

SEQ ID NO: 4101 - protein, 33 aa, Homo sapiens
TKPPLSVLFWGVGWVCVWGWVGMGNPSPSRSWG

SEQ ID NO: 4102 - protein, 39 aa, Homo sapiens
MIILNTIKVLILFVFVFMMCDNILGITQKELYFFKKFTF

SEQ ID NO: 4103 - protein, 29 aa, Homo sapiens
MWLQGLPAAILHAAGSAFHDPRQQPGPHS

SEQ ID NO: 4104 - protein, 33 aa, Homo sapiens
MIGCVIPYILILNYIIGGSFCFTLMCPGDSCLA

SEQ ID NO: 4105 - protein, 48 aa, Homo sapiens
MMVIVCVIVQKALSVPSPLQGTLLTPILQGLLQMPFSPGKPFRILSWI

SEQ ID NO: 4106 - protein, 49 aa, Homo sapiens
MHTHGSCLSMHWFCHWRPGIRPCWGAGAVRLRLILARAHTSKGQAGSAW

SEQ ID NO: 4107 - protein, 34 aa, Homo sapiens
MAACCSALLLLFPPCFHLCSLEAFPSWCVQDSSW

SEQ ID NO: 4108 - protein, 34 aa, Homo sapiens; identical to SEQ ID NO: 4107

SEQ ID NO: 4109 - protein, 21 aa, Homo sapiens
LLLHSVHLLLYEMTLRPPILL

SEQ ID NO: 4110 - protein, 36 aa, Homo sapiens
MTQNDLAAVLLRWRRPGLGWCSRLLTACCLPTLPAS

SEQ ID NO: 4111 - protein, 4 aa, Homo sapiens
MCAF

SEQ ID NO: 4112 - protein, 29 aa, Homo sapiens
PQVVCRVVFTPCQSPHSPARQTVFNSFHG

SEQ ID NO: 4113 - protein, 49 aa, Homo sapiens
EWGGLRKLIICACFPFTFCHDCKFLKPPQPFLTANRTVSKSNFLSFSLR

SEQ ID NO: 4114 - protein, 36 aa, Homo sapiens
CLQIASCFPFCQILIIFFFQKGKKKHKQPNFIFHIV

SEQ ID NO: 4115 - protein, 10 aa, Homo sapiens
MKTFVCAFDL

SEQ ID NO: 4116 - protein, 31 aa, Homo sapiens
MKMTFMYGRLTFFLSLPTLYLCYFYLPNKIP

SEQ ID NO: 4117 - protein, 84 aa, Homo sapiens
  SITE (25): Xaa equals any amino acid
MIWSAGRWTYAVLFHCCQTLLPWKXPLEKVWHHQDGQVGSGLSVQPRTQPPVSWLAVPGLAPFQQLSRPGRSGLSCSDSYSLIL

SEQ ID NO: 4118 - protein, 46 aa, Homo sapiens
MQVKVPSGRLAVTPFRLLAVALWTVSFLPLPLRRVVGTATSRLPDR

SEQ ID NO: 4119 - protein, 10 aa, Homo sapiens
SMVWLLGWCL

SEQ ID NO: 4120 - protein, 35 aa, Homo sapiens
MKSGCLKESGTPPFSCSCSCSPHDVTCLLSLCVLP

SEQ ID NO: 4121 - protein, 28 aa, Homo sapiens
MVNMGSAWPFLYGYFSLKMVLMFIHIYS

SEQ ID NO: 4122 - protein, 7 aa, Homo sapiens
MVDEKGF

SEQ ID NO: 4123 - protein, 4 aa, Homo sapiens
GFDL

SEQ ID NO: 4124 - protein, 60 aa, Homo sapiens [sequence omitted]

SEQ ID NO: 4125 - protein, 27 aa, Homo sapiens
MPPSPLGWCCGSIWWLYRQWVAAQLKN

SEQ ID NO: 4126 - protein, 119 aa, Homo sapiens
MLPLPSDAGLALLLQVCFSHSCGCRNLIYREEPVAAAAPATAALTVLTTHLGQPSLAGALVASHFPFPSLWLRGGVRGWRGRAAYHGLGLEEDEFVDLNKEFVILKKKKKKKKKKKKKK

SEQ ID NO: 4127 - protein, 6 aa, Homo sapiens
MAARGL

SEQ ID NO: 4128 - protein, 36 aa, Homo sapiens
VCSNMRSRSGTSSPARWGPATSRITWPSCSITVREP

SEQ ID NO: 4129 - protein, 49 aa, Homo sapiens
  SITE (34): Xaa equals any amino acid
  SITE (38): Xaa equals any amino acid
  SITE (39): Xaa equals any amino acid
MGLVRYVSISLCWFFCLQKPRFLFLFEKKKKKKXGGLXXGPGAHGFSHP

SEQ ID NO: 4130 - protein, 49 aa, Homo sapiens; identical to SEQ ID NO: 4129
  SITE (34): Xaa equals any amino acid
  SITE (38): Xaa equals any amino acid
  SITE (39): Xaa equals any amino acid

SEQ ID NO: 4131 - protein, 43 aa, Homo sapiens
MNQCRCIQFFFWKWKLHFIIVILRVIQDFEKSFGKNRKMLEKI

SEQ ID NO: 4132 - protein, 12 aa, Homo sapiens
MSCTLCFGSYVL

SEQ ID NO: 4133 - protein, 32 aa, Homo sapiens
MKSLLPGFGYCQSSPASFLYPFLSFPSLPRSS

SEQ ID NO: 4134 - protein, 43 aa, Homo sapiens [sequence omitted]

SEQ ID NO: 4135 - protein, 41 aa, Homo sapiens
MTISSQFLFFIFYFHLYVFEGRGKIKVCAHYTILVFPKSVP

SEQ ID NO: 4136 - protein, 33 aa, Homo sapiens
MGLVRYVSISLCWFFCLQKPRFLFLFEKKKKKK

SEQ ID NO: 4137 - protein, 66 aa, Homo sapiens
MGLQDNRILSPFLAIWVLFFKSFGLGRALFFFCFDIFIFSAVTGCQHNLHQLEIRNQKKKKKILTT

SEQ ID NO: 4138 - protein, 39 aa, Homo sapiens
MGRLGRELRTAYLLFILRLSYTSAGLSLRGTISSVSQPQ

SEQ ID NO: 4139 - protein, 30 aa, Homo sapiens
MWILSCIFMINVIVAVLPMRVGLEGLNNLS

SEQ ID NO: 4140 - protein, 38 aa, Homo sapiens
MPLNSLPQLAFHWELPLQFLVVLVCMTLGITVHHPHQS

SEQ ID NO: 4141 - protein, 243 aa, Homo sapiens
LAALSLHAAGSVLGVPPRAAVHPARRGRPAAGPGGLLHLPGGQPPEGPVPPHGWALPHLGQEAQGHRVLLHIRRRAEAPQQAAGVGLLGRGPPLQLRRRPDGQPGLLPGLWRWPPAALLLHHLHGHPADPPLPPGRAPLRQQVRPGLGALHRRSALPPAAWNLLRARPREKPCGAVKSVFCQVHGGWHPSSNSRSLSFLICKLERAQHLAGVQYLITLCSLLLPSREFRVSSTAVLPAQTDFL

SEQ ID NO: 4142 - protein, 33 aa, Homo sapiens
MLCSWFFLPLFLTILNIATTSTLCKHQVCAPYT

SEQ ID NO: 4143 - protein, 44 aa, Homo sapiens
VSLSCFLTLLPGLLCVHLRLAWSKQVRPLLLYSLVLFWHLVKLA

SEQ ID NO: 4144 - protein, 117 aa, Homo sapiens
  SITE (117): Xaa equals any amino acid
MDLSHLLALWCHPGLHCCWTCCSSPSQTTSFQSPFQFLLHPPPMASNSAALCSPLSVLSPEFHLLTRPGPLLPFPQALQLFFRTESLNSPFILLLLHLQKKKKKKKKKKKKKKKKKX

SEQ ID NO: 4145 - protein, 39 aa, Homo sapiens
MYLSISIFFFGFCIISCKCIVKNFIFGVAMRGGEVRLCT

SEQ ID NO: 4146 - protein, 32 aa, Homo sapiens
MPRGFTWLRYLGIFLGVALGNEPSENVALDAE

SEQ ID NO: 4147 - protein, 31 aa, Homo sapiens
MQCIIIFSILFCLFFCSCLTQNIKLVLQPTI

SEQ ID NO: 4148 - protein, 50 aa, Homo sapiens
MWIPLRPAPLHWSWRLIWEAVCALAPEGTWSTPHLENPHPEHSFPGAPLT

SEQ ID NO: 4149 - protein, 85 aa, Homo sapiens
MVGGPPFVGPVGFGPGDRSHLDSPEAREPCSCGGQLWPPRGPLSCVQPSSPTCYREQQPAPALWPYGPLTRPSWAPLCLGPLDHP

SEQ ID NO: 4150 - protein, 67 aa, Homo sapiens
MVSLALTLTIPSPILWTICMAILRVRTPCERPSSSCIQTGQTVTTLRPAVKHWWHSSLTTSGWSPQW

SEQ ID NO: 4151 - protein, 28 aa, Homo sapiens
MYIKLLIVLLESFALLSCLMEQFLMEMC

SEQ ID NO: 4152 - protein, 39 aa, Homo sapiens
MIWALGNLEVLGLCLCSSIFIRKESIGLLQGINPFVTYH

SEQ ID NO: 4153 - protein, 54 aa, Homo sapiens [sequence omitted]

SEQ ID NO: 4154 - protein, 38 aa, Homo sapiens
MSLNFVRIFIIVFHICEISSFFRVHRVSLFYRFLKMRF

SEQ ID NO: 4155 - protein, 179 aa, Homo sapiens
MGLIFAKLWSLFCNQEHKVIIVGLDNAGKTTILYQFLMNEVVHTSPTIGSNVEEIVVKNTHFLMWDIGGQESLRSSWNTYYSNTEFIILVVDSIDRERLAITKEELYRMLAHEDLRKAAVLIFANKQDMKGCMTAAEISKYLTLSSIKDHPWHIQSCCALTGEGLCQGLEWMTSRIGVR

SEQ ID NO: 4156 - protein, 81 aa, Homo sapiens
MFNFGSPMWLFVRSGLLKLDLARYSLPCWRFIPTNQLCGLWQPNGKWKIDCLQKAQGNYFFAHCAFIQSAQNFIKNTLGWS

SEQ ID NO: 4157 - protein, 55 aa, Homo sapiens
MFIYESNIANLSLIILFLKHQVYSQCVALMTISWERNRTAIMTNGKDSKAVSDGK

SEQ ID NO: 4158 - protein, 29 aa, Homo sapiens
MSLLPSMYLLCSTVEIFLPIFKLGFFFCY

SEQ ID NO: 4159 - protein, 31 aa, Homo sapiens
MTGCLCTVCIWLSRCLCAESMPPVGIRFYLF

SEQ ID NO: 4160 - protein, 33 aa, Homo sapiens
MSLWMHRLTSLSLQILSSAEGIIISHRTVMKTK

SEQ ID NO: 4161 - protein, 24 aa, Homo sapiens
MRNQGAWLWVSSICLACGASCGDQ

SEQ ID NO: 4162 - protein, 43 aa, Homo sapiens
MPARTSGKQSHICENSGRRCSLLLLVKCLERRGRSPTKGTPSG

SEQ ID NO: 4163 - protein, 32 aa, Homo sapiens
MMNYLLKLFTVPLPAICFLFFFSPAPSVCHMF

SEQ ID NO: 4164 - protein, 56 aa, Homo sapiens
MPTWVLCGRTSLLSHSWCGSGQQMKTPLPTTRSPTALSVHLSLAATSTSACTRAME

SEQ ID NO: 4165 - protein, 63 aa, Homo sapiens
MLPQMYLKSRHSFTKEEEAVLFCLIALVTKLMFTSLSLAPGSALILQKTELKSQAYFPVGLCL

SEQ ID NO: 4166 - protein, 34 aa, Homo sapiens
GLVVLFLPSSLALLLKSHRLRMRRAVKDTSSAAF

SEQ ID NO: 4167 - protein, 42 aa, Homo sapiens
MCGVCLCLLPRTITSFPFSHITALLAAAVVCCKSELINPTEY

SEQ ID NO: 4168 - protein, 100 aa, Homo sapiens
MWHLLVFIVCVFFVYYTLGNFVLPKKKKKGSVMSDTQEKQISVVSLKYNFKGHYQQQGFFYTLKTLCYISLPFSYFGVLLLLYNGINGNVIQPLNCHYYI

SEQ ID NO: 4169 - protein, 41 aa, Homo sapiens
WGCQKWRLQPPRVSSSGAPCFVPPSCAIQRGPPGLAETPPG

SEQ ID NO: 4170 - protein, 3 aa, Homo sapiens
MEM

SEQ ID NO: 4171 - protein, 30 aa, Homo sapiens
MPGVFFFFVFFFNSYFGCALVSQCSFNLHF

SEQ ID NO: 4172 - protein, 60 aa, Homo sapiens
MRSVPAILQMLWILRRSTNWTLYLILHGCPAVVCAWPRQHAPWGMVRLWVPTAAPAALSP

SEQ ID NO: 4173 - protein, 38 aa, Homo sapiens
MEKTLKVLFLFSHPATINTVDFCEMCGVFSPDTKQVLT

SEQ ID NO: 4174 - protein, 21 aa, Homo sapiens
VHKKHSTGTKSFSKPAVFGEH

SEQ ID NO: 4175 - protein, 57 aa, Homo sapiens
MALDSSTLVALLGTAPLLAAFTAGVECLWLFQALSASCPWIDHSGVWRTVALFSQLH

SEQ ID NO: 4176 - protein, 51 aa, Homo sapiens
MAPCCWALWVGSAPWEPASMPGPHSSHSCWSLAPWPLCSSILWVWGRRTSA

SEQ ID NO: 4177 - protein, 35 aa, Homo sapiens
MLAVLSLCNFCRCSLGRELFFRRLAKSQVLSLDLR

SEQ ID NO: 4178 - protein, 186 aa, Homo sapiens
LAGRLPHPGRPAAQLLRVCRTHEAPGGHGPAGLGAAATLPAPARPERLPGPRLCALRRGRLGHGAGALRPARVRGELRQGPGRAQTPRPPSCSPSWASLTSSRGRPRASWRGLGRCGPTPSTSSASPCSSTASRTWRALRRATTAASWSSASSLASPTAWWGPCSSRCSWPSWAPTSSPVPLAWCC

SEQ ID NO: 4179 - protein, 57 aa, Homo sapiens
MTLLLLSLTPHPNAHCCCPKRTYQCVDVSRKVPFLFGLVVLDCFLTSFNFSHFLTDY

SEQ ID NO: 4180 - protein, 23 aa, Homo sapiens
EKSRKVGHSWIYFFFSLINIFPY

SEQ ID NO: 4181 - protein, 453 aa, Homo sapiens
MSIVTVQLGQCGNQIGFEVFDALLSDSHSSQGLCSMRENEAYQASCKERFFSEEENGVPIARAVLVDMEPKVINQTLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 4182 - protein, 21 aa, Homo sapiens
MRARPSPSPLRSWACRPPCCC

SEQ ID NO: 4183 - protein, 78 aa, Homo sapiens
MGHLIQRKKVHVFGDELSLVTLFRCIQNMPETLPNNSCYSAGIAKLEEGDELQLAIPRENAQISLDGDVTFFGALKLL

SEQ ID NO: 4184 - protein, 32 aa, Homo sapiens
MTQVTISKLGRLLLLALPLCPISCQYSQFSRE

SEQ ID NO: 4185 - protein, 35 aa, Homo sapiens
MDHFLVFFFLIGALNKYGTWTKRFSGILWKLTFLT

SEQ ID NO: 4186 - protein, 68 aa, Homo sapiens
FFFFFFFKLHGTEFNVNHEMRQKPPPGRWEDPAPNQTLEHAALNQTPGRGCVVMHRLRLRGEDGKTQP

SEQ ID NO: 4187 - protein, 50 aa, Homo sapiens
MAVALETVLIIFSLFGTTLTKLVVLLLHVQKLDILYMQQFSYATMRQEEH

SEQ ID NO: 4188 - protein, 8 aa, Homo sapiens
MKLYFLMC

SEQ ID NO: 4189 - protein, 97 aa, Homo sapiens
RQPCPGLWPPPFYSPCGLGLCSLHDRPALVVGAHRVPTPGLHCGCLRVPADDRLPPGAAPTLQRGRECEAGPCEAQGADLSGQGPSPHSAALALSIH

SEQ ID NO: 4190 - protein, 310 aa, Homo sapiens
  SITE (127): Xaa equals any amino acid
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSXGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 4191 - protein, 64 aa, Homo sapiens
MESGQVSLFGLVFSLMPCCQHIQKGAACPKTVNLRRPQLSGLLISWRFLKCILLDFNGWVWKSP

SEQ ID NO: 4192 - protein, 16 aa, Homo sapiens
MALSFIFPSDFCPSFL

SEQ ID NO: 4193 - protein, 16 aa, Homo sapiens
MVVLFLFPITVLALKL

SEQ ID NO: 4194 - protein, 31 aa, Homo sapiens
MSASLNHIKVSSVWLLLLFEMVLCFGCGLKL

SEQ ID NO: 4195 - protein, 39 aa, Homo sapiens
MKEQLAQFLKVTSSFRLLLLLTWMGLGIAPLTLCYTAIT

SEQ ID NO: 4196 - protein, 39 aa, Homo sapiens; identical to SEQ ID NO: 4195

SEQ ID NO: 4197 - protein, 39 aa, Homo sapiens; identical to SEQ ID NO: 4195

SEQ ID NO: 4198 - protein, 35 aa, Homo sapiens
MLRVMNLFHLLFEIATCLICLSISSKNSGENSMIE

SEQ ID NO: 4199 - protein, 37 aa, Homo sapiens
MLDFLRSQLKLLSYLLLGFLLLRQRGIGRTSEIFVNS

SEQ ID NO: 4200 - protein, 23 aa, Homo sapiens
MSQACLQLAMLSPSPLPGGTTAK

SEQ ID NO: 4201 - protein, 310 aa, Homo sapiens
  SITE (307): Xaa equals any amino acid
MMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGPLTGPRRRSICAAWAGATSSSCPSSTCVTTACATSCLSLSTAASRCSLPALVSPWAMACARWGWSGWLTSSWLTAWAPQPPHSWACWACGCHARCPWWPEQGCTCCSPSSSFSGPLCLGSCNTAGSSMWQLPFGVXAVP

SEQ ID NO: 4202 - protein, 310 aa, Homo sapiens
MMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGPLTGPRRRSICAAWAGATSSSCPSSTCVTTACATSCLSLSTAASRCSLPALVSPWAMACARWGWSGWLTSSWLTAWAPQPPHSWACWACGCHARCPWWPEQGCTCCSPSSSFSGPLCLGSCNTAGSSMWQLPFGVWAVP

SEQ ID NO: 4203 - protein, 370 aa, Homo sapiens
  SITE (370): Xaa equals any amino acid
MMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAX

SEQ ID NO: 4204 - protein, 137 aa, Homo sapiens
  SITE (54): Xaa equals any amino acid
MVSVCFYFIRDYFWWLLTYTFFALMLQFLVMLTKCGFSFLKSCLGFIVFGFCEXFSHKIWKNSAFSSSVTAFCFCPPSFAILIERRPFYSLSCLLTSFFCFPFLCLSVLPSDYFIRTICQFPNSLFGFVSSVIRNIY

SEQ ID NO: 4205 - protein, 10 aa, Homo sapiens
MIQCCIMILL

SEQ ID NO: 4206 - protein, 39 aa, Homo sapiens [sequence omitted]

SEQ ID NO: 4207 - protein, 50 aa, Homo sapiens
MFLSSNFPIFSILFFAFPYFCLPVFHFKLLSSPNCFILPLPINLSIFVCV

SEQ ID NO: 4208 - protein, 50 aa, Homo sapiens
MFLPSNFPIFSILFFAFPYFCLPVFHFKLLSSPNCFILPLPINLSIFVCV

SEQ ID NO: 4209 - protein, 32 aa, Homo sapiens
MAKIHVMSINLYFLSPALLSMAMGLTPEGCKS

SEQ ID NO: 4210 - protein, 55 aa, Homo sapiens
MHAHIWPYLYMCAHIHMHLCTYMPIHTHTHTHAHTHQPQSHSFCGGTSGLRAAPG

SEQ ID NO: 4211 - protein, 23 aa, Homo sapiens
MAPIMRLLEAIFMTAIVPSVLQL

SEQ ID NO: 4212 - protein, 49 aa, Homo sapiens
HLPCKLVFFLSDKFWYCRLSPNHKVLHYGDLEESPQGEVPHDSLQDKRK

SEQ ID NO: 4213 - protein, 29 aa, Homo sapiens
VIVIVQLCIFYASYSAWHIVGAQLTLLKE

SEQ ID NO: 4214 - protein, 126 aa, Homo sapiens [sequence omitted]

SEQ ID NO: 4215 - protein, 52 aa, Homo sapiens
MHTACLCNAIIALLKVPLSFQRYFFPETTVYQHQACSVTIAPESCRAHCCPE

SEQ ID NO: 4216 - protein, 50 aa, Homo sapiens
MVSCLLRTARQHCVCEDVLHLLLCASQLLLLKQLSLLFGFLRLLASERHL

SEQ ID NO: 4217 - protein, 37 aa, Homo sapiens
MKRRERRWKWFFFFFFYFLSFFFFFFLVNSRFSSSKF

SEQ ID NO: 4218 - protein, 34 aa, Homo sapiens
MKNIIAISPKFLSWLGWGRFLLWTISGTYSMKSR

SEQ ID NO: 4219 - protein, 37 aa, Homo sapiens
MLCSLLLLFLLLFVIPKSPWQHTSGWFATCSERLIKN

SEQ ID NO: 4220 - protein, 75 aa, Homo sapiens
MQMLRKLFTAIRALFLAVCVLKVIVSLVSLGVGLRNLCGQSSQPLNEEGSEKRLLGENSVPPSPSREQTSTAIVL

SEQ ID NO: 4221 - protein, 35 aa, Homo sapiens
MLHLCSLLQGVLGKCRYVYYGKNSEGNRFIRDDQL

SEQ ID NO: 4222 - protein, 25 aa, Homo sapiens
FQCPCVHVSALQELAAGVLGGPRPV

SEQ ID NO: 4223 - protein, 9 aa, Homo sapiens
MHSCRNHDR

SEQ ID NO: 4224 - protein, 37 aa, Homo sapiens
MRFHILLIVLLLRMKNQQQILCWTCGLVKLLFLVLPV

SEQ ID NO: 4225 - protein, 36 aa, Homo sapiens
  SITE (16): Xaa equals any amino acid
  SITE (33): Xaa equals any amino acid
MRGLFFFSLLDKVLAXCNCLLSYSTAEMKQSFXCTD

SEQ ID NO: 4226 - protein, 31 aa, Homo sapiens
MDLQVCMGSKYWFMVLFLELLVGLYFGVVFG

SEQ ID NO: 4227 - protein, 85 aa, Homo sapiens
MPRSGPLSIPWPLWLPLGYVVCVREWCAGAVPYAPCVLCVSRHGSLRPMCAVCVLPVYVASSDADKVGNNPCQSGLGPDFVLFLT

SEQ ID NO: 4228 - protein, 207 aa, Homo sapiens [sequence omitted]

SEQ ID NO: 4229 - protein, 33 aa, Homo sapiens
MRYLIFLLLHLSFSWLQKIMAFTVFLFSFMSSF

SEQ ID NO: 4230 - protein, 34 aa, Homo sapiens
MWPIASLTYMGKPLALCSPAFLLCLVHAVSSQQP

SEQ ID NO: 4231 - protein, 31 aa, Homo sapiens
MKLFQYIQYTLSLMLLLLTVISFFFSFLYLH

SEQ ID NO: 4232 - protein, 31 aa, Homo sapiens; identical to SEQ ID NO: 4231

SEQ ID NO: 4233 - protein, 33 aa, Homo sapiens
MYVVTVYMCMSVVYACVSVCLYVCTTKEAAETL

SEQ ID NO: 4234 - protein, 55 aa, Homo sapiens
EILHRFLVLFCSFFVFCCFVIYLYTYKILLKIKKKKKSRSRIHWSRFSYNVLKTK

SEQ ID NO: 4235 - protein, 75 aa, Homo sapiens [sequence omitted]

SEQ ID NO: 4236 - protein, 6 aa, Homo sapiens
LKGIYL

SEQ ID NO: 4237 - protein, 12 aa, Homo sapiens
HETIVTWRPQLL

SEQ ID NO: 4238 - protein, 59 aa, Homo sapiens
MATLLLCPHVAFPLYVRAPATSILRGHQSYWIRVPPQQLHVNIISLKTLPPAGHGSSRL

SEQ ID NO: 4239 - protein, 24 aa, Homo sapiens
MFDLLFISTFILIFLASLDLEVNY

SEQ ID NO: 4240 - protein, 38 aa, Homo sapiens
MVFILTISYLLKGVMVITKAFRMQFLICCGHDHKKISQ

SEQ ID NO: 4241 - protein, 32 aa, Homo sapiens
MSMECFSICYVISDFFVQCFVTFIVEILYLPG

SEQ ID NO: 4242 - protein, 79 aa, Homo sapiens
MDDFISISLLSLAMLVGCYVAGIIPLAVNFSEERLKLVTVLGAGLLCGLLWQSSCLKEYMPFMKIFLRENTTKQVKHIM

SEQ ID NO: 4243 - protein, 55 aa, Homo sapiens
MTRLSFLGLFLLRPAPSWAHLRFTEVSGGPKSLLVFNFFLTIHFCGQFQQHCPYF

SEQ ID NO: 4244 - protein, 4 aa, Homo sapiens
MQST

SEQ ID NO: 4245 - protein, 30 aa, Homo sapiens
MYIRLFLIFCYLYAHCSEHSLYICPCSVVS

SEQ ID NO: 4246 - protein, 20 aa, Homo sapiens
MFLIFYLAKLDNLSLGKIKN

SEQ ID NO: 4247 - protein, 59 aa, Homo sapiens
STLFSILLSRLWGSFCQGQATRKVEVEITWYVSLWVPQLELPQLRKKMRHNDLECNWSK

SEQ ID NO: 4248 - protein, 30 aa, Homo sapiens
MLALNIFFLSLTSAINSTIGLQIQFTLGLN

SEQ ID NO: 4249 - protein, 34 aa, Homo sapiens
MESIYCRTTLVLCLLSLPSALQLSPSLAASSLCS

SEQ ID NO: 4250 - protein, 44 aa, Homo sapiens
MTRHLLIIFHDCFLFSHCVGFVNLYITGNKILCKIYWGKSIWSA

SEQ ID NO: 4251 - protein, 16 aa, Homo sapiens
MLQRIVLACCWPAASQ

SEQ ID NO: 4252 - protein, 68 aa, Homo sapiens
MDFHFLVVFFFSYHFPFLFLHVGNLSSAAFLCQLKGKSHLNAHQENTLWSAIQSFIMYPLTVMPARRD

SEQ ID NO: 4253 - protein, 38 aa, Homo sapiens
MKKMSQRSGTLWLALLLHSVVTTGVIGDIMWAKNISGL

SEQ ID NO: 4254 - protein, 29 aa, Homo sapiens
MLIWGSHLLPLGQSTIKLLYLPWLLDHVC

SEQ ID NO: 4255 - protein, 10 aa, Homo sapiens
MLNCDHFLAL

SEQ ID NO: 4256 - protein, 31 aa, Homo sapiens
MGINTRELFLNFTIVLITVILMWLLVRSYQY

SEQ ID NO: 4257 - protein, 36 aa, Homo sapiens
MKTTSFYCIFTRVHSGRMLIAGSVQATDMLLLVIQY

SEQ ID NO: 4258 - protein, 42 aa, Homo sapiens
MVMFVLCLNYWDLVLTISLKKTAFCHFKLTTSGRWRIRSASQ

SEQ ID NO: 4259 - protein, 23 aa, Homo sapiens
LPLSLFSVLLTLLFLVVFKKIAT

SEQ ID NO: 4260 - protein, 14 aa, Homo sapiens
MLLIWVFLPVLTTD

SEQ ID NO: 4261 - protein, 118 aa, Homo sapiens
  SITE (109): Xaa equals any amino acid
  SITE (115): Xaa equals any amino acid
MAHGLYSILIGLGLLTGLLLLHNWSPCFQFLPSISSNLTPKVILSSLKKKKKNSRGGPVPNSPYSESYYNSLAVVLQRRDWENPGVTQLNRLAAHPPFASWRNSEEARXDRPSQXLRT

SEQ ID NO: 4262 - protein, 35 aa, Homo sapiens
PLELTSWTLLLYCLNCSALYFASVCEFCCFWGISL

SEQ ID NO: 4263 - protein, 1 aa, Homo sapiens
M

SEQ ID NO: 4264 - protein, 23 aa, Homo sapiens
MILLIIPSFRLSPFSSSTIKEPL

SEQ ID NO: 4265 - protein, 113 aa, Homo sapiens
MSFCFQLLLGVAMSQPQSLISPVSITNCLHLKAFLYLLIFPQAFPFLSCIFPLFWQTCMGKDVTLHVSASNPAMLLYQKFGFKTEEYVLDFYDKYYPLESTECKHAFFLRLRR

SEQ ID NO: 4266 - protein, 42 aa, Homo sapiens
MSNYTILGQYCVFLVLCFLRSPTYWNFDYLDIFVFKRGGEFA

SEQ ID NO: 4267 - protein, 10 aa, Homo sapiens
EFTFPCAGLT

SEQ ID NO: 4268 - protein, 23 aa, Homo sapiens
MSVLLLSSSCGAAFAVLCPPHCE

SEQ ID NO: 4269 - protein, 13 aa, Homo sapiens
MGCFGLWAPSFPW

SEQ ID NO: 4270 - protein, 86 aa, Homo sapiens
MLMLLTLFSSLGMFGTGGLGGRVFCPHTHTDSEYLIHVVDSPITVQWGRGPRFFPFLSPFISCGQRLQPTIALRVPSSAFSKYGLT

SEQ ID NO: 4271 - protein, 35 aa, Homo sapiens
  SITE (9): Xaa equals any amino acid
MFVYCPHLXLIYSGILLLLEHIVYSCNNYFNIFAY

SEQ ID NO: 4272 - protein, 17 aa, Homo sapiens
RGRPGALPSCLFSVFPL

SEQ ID NO: 4273 - protein, 25 aa, Homo sapiens
MQVLLLLVGFFQMELSLFILKNMKI

SEQ ID NO: 4274 - protein, 18 aa, Homo sapiens
MTNLLFAYSSILNKSLKL

SEQ ID NO: 4275 - protein, 118 aa, Homo sapiens
  SITE (34): Xaa equals any amino acid
  SITE (52): Xaa equals any amino acid
MGLVICSFLALKIVVSKRDHGRNHCNGSNSNTCXLYCALGLPGVSKYISIFXMCRTRYLGTCHTPLSRYVLASLELKGLELRTCSLFFIHMSLVGLHPDHTMTSYRARENNIIISSFA

SEQ ID NO: 4276 - protein, 14 aa, Homo sapiens
LTWLLLPHRAARSQ

SEQ ID NO: 4277 - protein, 380 aa, Homo sapiens
MRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 4278 - protein, 11 aa, Homo sapiens
MRWNLLLVKLL

SEQ ID NO: 4279 - protein, 31 aa, Homo sapiens
MFVFTIYCIVGLFTFGHSSMKCKLFQESHEK

SEQ ID NO: 4280 - protein, 28 aa, Homo sapiens
MAFSFPASAGVVRVGARRALLFPFLLPG

SEQ ID NO: 4281 - protein, 105 aa, Homo sapiens
MAHKIGPPMLFFFLSLFNYLLRLSKAKGNCEIKSVKYNNIFKRKWIPLFLFATEKAPRRHRLCRISKQTMMEWRPVQPFKERQVEQPGERPGGEESETPESKAVF

SEQ ID NO: 4282 - protein, 22 aa, Homo sapiens
EVQYVQIFHIFLLLSLYLFSLF

SEQ ID NO: 4283 - protein, 39 aa, Homo sapiens
MTIIMCPLAPLISGVCAIPLSTSLIFLTPSLTKSLQKPL

SEQ ID NO: 4284 - protein, 28 aa, Homo sapiens
MRSLICPNPHQRLLFSVLLIITILMGMN

SEQ ID NO: 4285 - protein, 36 aa, Homo sapiens
  SITE (25): Xaa equals any amino acid
  SITE (31): Xaa equals any amino acid
MLRKVILCMLPFCFILLLKQNCGVXLCVCAXPRCPS

SEQ ID NO: 4286 - protein, 22 aa, Homo sapiens
MNVFSKNVKCIYFLYLYSCFIF

SEQ ID NO: 4287 - protein, 32 aa, Homo sapiens
MILFLLLLWSCISSVRSHGYLQIKAPINQMHL

SEQ ID NO: 4288 - protein, 38 aa, Homo sapiens
MPSPEKNFYHLLLPFLLALLKALKCDSSSIASTSMYNF

SEQ ID NO: 4289 - protein, 21 aa, Homo sapiens
MILFFHFLSTYVEASLPKHNL

SEQ ID NO: 4290 - protein, 71 aa, Homo sapiens
MASWETFKRPSLILSAYSNSITGITDDVSIGLASTSTVTRCLLSPKVLSKVSVARTEFRMVSRYATWRGPR

SEQ ID NO: 4291 - protein, 145 aa, Homo sapiens
  SITE (85): Xaa equals any amino acid
QVVGMTVEHVECQDAGVREAPGPLEGAGEAGGEEADEKPPQFVCRECKETFSTMTLLRRHERSHPELRPFPCTQCGKSFSDRAGXRKHSRTHSSVRPYTCPHCPKAFLSASDLRKHERTHPVPMGTPTPLEPLVALLGMPEEGPA

SEQ ID NO: 4292 - protein, 32 aa, Homo sapiens
MNLPSVNLGFRCFYLFIDFCFPSSIFFCTEFT

SEQ ID NO: 4293 - protein, 117 aa, Homo sapiens [sequence omitted]

SEQ ID NO: 4294 - protein, 30 aa, Homo sapiens
  SITE (28): Xaa equals any amino acid
MRLFSQMLKSWMALFMRNVWLEMTIATXIQ

SEQ ID NO: 4295 - protein, 50 aa, Homo sapiens
MFSLIILLVKYDIPKENHFNLSSLLTKNTWLKKYSLHLYEHLPYNIPAII

SEQ ID NO: 4296 - protein, 14 aa, Homo sapiens
MKDGSRSLPQLSIC

SEQ ID NO: 4297 - protein, 37 aa, Homo sapiens
MPVVFVLFSLFLTCVHDSFDSASKSKSCVVTGAFIYL

SEQ ID NO: 4298 - protein, 56 aa, Homo sapiens
MLHLTPLKLPFCCWEESGASLSSCTAIPMLVGAALPLVPGVASAQSQRAGSRVLHR

SEQ ID NO: 4299 - protein, 90 aa, Homo sapiens
MTSPHFQLSSSLFMWLCWGWMAEVGWTDGYKRICESIEGVTKSLRDKRGNRTFQKVVLLLSQTLYIHVYFCKLLSPFGQTTITRVKSYQE

SEQ ID NO: 4300 - protein, 37 aa, Homo sapiens
MRKGIHYITFLVSLCSLFHFYQTEGVNFLTRNLKDRN

SEQ ID NO: 4301 - protein, 6 aa, Homo sapiens
MCHVTT

SEQ ID NO: 4302 - protein, 32 aa, Homo sapiens
MSDPLLRITLGLWGMWLFCGRQAHLGFLWRGR

SEQ ID NO: 4303 - protein, 13 aa, Homo sapiens
MASLGQILFWSII

SEQ ID NO: 4304 - protein, 35 aa, Homo sapiens
MVCLPVHSRALLTGFLFFKMLCCKILSYLLFPGTV

SEQ ID NO: 4305 - protein, 62 aa, Homo sapiens
MGLSAASQICGLCLLWLSPHFASQICPPVHILPTSNPGSVSASQRTWTKALAVSGLVDPSTS

SEQ ID NO: 4306 - protein, 28 aa, Homo sapiens
MTFFLLWFICILLVLFQKNSIEMRHRYQ

SEQ ID NO: 4307 - protein, 74 aa, Homo sapiens [sequence omitted]

SEQ ID NO: 4308 - protein, 18 aa, Homo sapiens
MCIQLLLLLLVWGRGLES

SEQ ID NO: 4309 - protein, 30 aa, Homo sapiens
MLISLSLSLSLLTKVYQRPQAQGLSQVKAG

SEQ ID NO: 4310 - protein, 26 aa, Homo sapiens
NFKHQFTMLIKSTFIFSSELNNPINK

SEQ ID NO: 4311 - protein, 20 aa, Homo sapiens
MYKSCGFLCFYDKSGIVFLN

SEQ ID NO: 4312 - protein, 34 aa, Homo sapiens [sequence omitted]

SEQ ID NO: 4313 - protein, 16 aa, Homo sapiens
MWIGVVLSIWKLLLEI

SEQ ID NO: 4314 - protein, 27 aa, Homo sapiens
MATLTFSLRKPLQRSLIRPSRLPLCCF

SEQ ID NO: 4315 - protein, 68 aa, Homo sapiens
MSCYFLLCLSLLQPHWPSYCSINMPGTFLPQGLCTSHAFCSSRFLQSSFPTSFMSLLVHLLMRLSYHV

SEQ ID NO: 4316 - protein, 12 aa, Homo sapiens
MWRHTELPPVYV

SEQ ID NO: 4317 - protein, 44 aa, Homo sapiens
MIFPLQEFSLFGQWWLQVFLEGIIFIPTILLYVHTCVPSNSHSI

SEQ ID NO: 4318 - protein, 6 aa, Homo sapiens
EIPYKE

SEQ ID NO: 4319 - protein, 26 aa, Homo sapiens
MEPGFDLSHSCFGVCPLNTLYGVSNL

SEQ ID NO: 4320 - protein, 30 aa, Homo sapiens
MGNLFFLALLVNLWVYPVATLRISIINKTQ

SEQ ID NO: 4321 - protein, 5 aa, Homo sapiens
MPKIL

SEQ ID NO: 4322 - protein, 5 aa, Homo sapiens
MPKIL

SEQ ID NO: 4323 - protein, 6 aa, Homo sapiens
MFQGQW

SEQ ID NO: 4324 - protein, 31 aa, Homo sapiens
MTFCFCIGFTVIQFSSLISSKTKSECTRFFR

SEQ ID NO: 4325 - protein, 109 aa, Homo sapiens
MVFLPAHSQPFLFPFLFFFSPHTFLGLPPWKEEGLTWVLSSPQVRRVTRAPSLWTWALPEPLPQLPQLRPAGPGHGLRKSPAPNPGRNWPLLGSLFDFFRKMISISFQP

SEQ ID NO: 4326 - protein, 19 aa, Homo sapiens
MLEYGLLLLVILVLFPSFP

SEQ ID NO: 4327 - protein, 26 aa, Homo sapiens
MHPDLWPDCGLWLPQAFSSLHWVFLH

SEQ ID NO: 4328 - protein, 36 aa, Homo sapiens
MIRYWGFGGTQTLAILCVPLDQSPKRRGAGRKEWGS

SEQ ID NO: 4329 - protein, 63 aa, Homo sapiens
MFYILFICLGSRVLNLERSTSIETYGSCSLESQWRLIAVLHMNSNLTLNHQQTLSFHQDVDKE

SEQ ID NO: 4330 - protein, 5 aa, Homo sapiens
SYCSV

SEQ ID NO: 4331 - protein, 30 aa, Homo sapiens
MKLEAFIDFCCFLVVLTWIQVVLIHLFCLK

SEQ ID NO: 4332 - protein, 10 aa, Homo sapiens
MLLLDSDVWF

SEQ ID NO: 4333 - protein, 14 aa, Homo sapiens
MPWLQQLVSFGLMS

SEQ ID NO: 4334 - protein, 41 aa, Homo sapiens
ESLLLVIAFLFFCSFSFPSIKDLLYAFRKITKAECLLTIYG

SEQ ID NO: 4335 - protein, 15 aa, Homo sapiens
KNCYPKGFLRANCLL

SEQ ID NO: 4336 - protein, 15 aa, Homo sapiens
MTQGIIFLVCILDVL

SEQ ID NO: 4337 - protein, 40 aa, Homo sapiens
MKSTNFLKQALFFFFWKTCVVCPVYLFLMRRPAFCGPREH

SEQ ID NO: 4338 - protein, 53 aa, Homo sapiens
MGSSTFILFFSFLLFSPFLSPSPTTSLYFFFIYSRLIFSAKRCLGPLTSQEAL

SEQ ID NO: 4339 - protein, 11 aa, Homo sapiens
MHFHADYMHGC

SEQ ID NO: 4340 - protein, 37 aa, Homo sapiens
NSLKTIIFALKTVVFLDLPVYAHSLLWHLYSYCNAYS

SEQ ID NO: 4341 - protein, 55 aa, Homo sapiens
MTFSPALPPLRSPCSELLLWRYPGSLIPEALRLLRLGDTPSPPYPATPAGDIMEL

SEQ ID NO: 4342 - protein, 19 aa, Homo sapiens
GMLHDGQLLPSLVIIHCSC

SEQ ID NO: 4343 - protein, 29 aa, Homo sapiens
LELLVCNYVYGNGVVFMICIYIIIWMYIY

SEQ ID NO: 4344 - protein, 50 aa, Homo sapiens
WPLLPQVLQERVWWAHLQSQLLGKLQGLLEPRKSQLAGHLELPKNTLSRK

SEQ ID NO: 4345 - protein, 62 aa, Homo sapiens
MFLGSLGICRFALWILTVFKVLMISQSFFLTSEKKMHCFLIFPMQNQNKKLILCFKKKKKNS

SEQ ID NO: 4346 - protein, 40 aa, Homo sapiens
MKGVLLINLLYYLDTFVYSLQPTCIRGIGVGLNHQHYFIK

SEQ ID NO: 4347 - protein, 142 aa, Homo sapiens [sequence omitted]

SEQ ID NO: 4348 - protein, 43 aa, Homo sapiens
MMLLNSIQVLLYVPIVFRFLTDCCGCTSLSDCSLIYCRTLGCF

SEQ ID NO: 4349 - protein, 36 aa, Homo sapiens
MCILFCTPISLFLCWLPGPSLEPWVERLLKDHHRQP

SEQ ID NO: 4350 - protein, 81 aa, Homo sapiens [sequence omitted]

SEQ ID NO: 4351 - protein, 7 aa, Homo sapiens
MTIFEPS

SEQ ID NO: 4352 - protein, 51 aa, Homo sapiens [sequence omitted]

SEQ ID NO: 4353 - protein, 40 aa, Homo sapiens [sequence omitted]

SEQ ID NO: 4354 - protein, 17 aa, Homo sapiens
MSTGHGACLVSLPVVQA

SEQ ID NO: 4355 - protein, 41 aa, Homo sapiens
MRTLLFLSLAFKACHNLVTPLIPVSSSIFPATHRFPVFTIS

SEQ ID NO: 4356 - protein, 7 aa, Homo sapiens
MICLALY

SEQ ID NO: 4357 - protein, 57 aa, Homo sapiens
  SITE (39): Xaa equals any amino acid
MTGLYAVGRGAWTAGLCAVGWGGLDVWLLCGAGAGLGPXGRLEGQPGPVVSLVRNRK

SEQ ID NO: 4358 - protein, 52 aa, Homo sapiens
MPAVSAFFSLAALAEVAAMENVHRGQRSTPLTHDGQPKEMPQLPVLISCADQ

SEQ ID NO: 4359 - protein, 38 aa, Homo sapiens
MLITLIIVVGTFCSWVQAYFTHIWLLCLFWKTAASWSD

SEQ ID NO: 4360 - protein, 22 aa, Homo sapiens
MKFVLFYLCTGYPLFWECFFIL

SEQ ID NO: 4361 - protein, 15 aa, Homo sapiens
DTIVLSGCLCLCYYV

SEQ ID NO: 4362 - protein, 10 aa, Homo sapiens
MGTSSILQMK

SEQ ID NO: 4363 - protein, 43 aa, Homo sapiens
MVCGEWVPGMLRALRAALFLFIAISVKLSFLGNVHRLATADVL

SEQ ID NO: 4364 - protein, 68 aa, Homo sapiens
KLWQTMCDAFFCIGCSHWIAGSGYCVIVAALGLAEGPLCLDSLGQWNYTFAQHRGPVPSGYLHMVRVH

SEQ ID NO: 4365 - protein, 26 aa, Homo sapiens
MALTGAFIVKSYSRGWSCGCVCSVPI

SEQ ID NO: 4366 - protein, 10 aa, Homo sapiens
MLWIFKWQVL

SEQ ID NO: 4367 - protein, 218 aa, Homo sapiens
MGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 4368 - protein, 195 aa, Homo sapiens
MGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGSSLGEFSWWDQESRAFFLSTEKKNLGTK

SEQ ID NO: 4369 - protein, 21 aa, Homo sapiens
MSWILFLLALVEHIFPLQSSG

SEQ ID NO: 4370 - protein, 18 aa, Homo sapiens
GRSYVKNQVFCGIFYRNR

SEQ ID NO: 4371 - protein, 41 aa, Homo sapiens
MKCFLLLCCAIVLCFSKHCKNSIFGLVFWIIYYNLRSVLLM

SEQ ID NO: 4372 - protein, 21 aa, Homo sapiens
MFIYLAVFVYLLELWSQLPGT

SEQ ID NO: 4373 - protein, 29 aa, Homo sapiens
MSKPKKYTIVLVLLPYREAIQTVGMNLSY

SEQ ID NO: 4374 - protein, 45 aa, Homo sapiens
MVTSGMLVFSIKTFSSKAFLAVVSFILVVSIKCSEGADTSRKGFS

SEQ ID NO: 4375 - protein, 38 aa, Homo sapiens
MSALLEILALLLHSVSGPGMGVFRSSPSFPGAATWLFG

SEQ ID NO: 4376 - protein, 38 aa, Homo sapiens; identical to SEQ ID NO: 4375

SEQ ID NO: 4377 - protein, 30 aa, Homo sapiens
MRFFCSLMFFGYGYGICRLGGKELKITGAG

SEQ ID NO: 4378 - protein, 35 aa, Homo sapiens
MNNLLILFLKTSCLCFLICVCIFKHFVRLSATLGS

SEQ ID NO: 4379 - protein, 78 aa, Homo sapiens
MYIALSSVHALILCGFQFISCVRGQWTECSDFSPPITVILLIFLCLEGLLFFTFTGSYVWHPNPLHMQRRDGDRAIEK

SEQ ID NO: 4380 - protein, 8 aa, Homo sapiens
MLASGEYI

SEQ ID NO: 4381 - protein, 34 aa, Homo sapiens
MNVFFFPCWSLIFMIVFQFLDLTSCMRSTESTQE

SEQ ID NO: 4382 - protein, 76 aa, Homo sapiens
MKKHVLVAHFHYLINSYFGLRTEEMGEQPKTNDTVSIEKIPPPDKYYCKKCNAQCQQPGCVNVSHFDIRHTQRFGE

SEQ ID NO: 4383 - protein, 12 aa, Homo sapiens
MNGRRLIFPYVL

SEQ ID NO: 4384 - protein, 49 aa, Homo sapiens [sequence omitted]

SEQ ID NO: 4385 - protein, 20 aa, Homo sapiens
MFSWKLLYSLILHGLALNCL

SEQ ID NO: 4386 - protein, 30 aa, Homo sapiens
MFVLLFSEIFLSTVAGKLRSGPCAACLLLP

SEQ ID NO: 4387 - protein, 34 aa, Homo sapiens
MTRDDTLSLWLGLVILINCLYLYLTETSLKMPLY

SEQ ID NO: 4388 - protein, 28 aa, Homo sapiens
ILSTGFCFLLFLFVLRKGKKSQVCLTIQ

SEQ ID NO: 4389 - protein, 37 aa, Homo sapiens
MSFSLSLTTQYLCVSLSLVMKCLSLWPVSHCLYICFP

SEQ ID NO: 4390 - protein, 31 aa, Homo sapiens
MHRKFCIFTLLLVFSRSESEHLPFLAAAGAL

SEQ ID NO: 4391 - protein, 73 aa, Homo sapiens
MTVLLLLIPLSKREPFSKSFDGKSSGIHFAVLIGLLLTFCFLILKSCKGHPFLFSSQCRDYTDKVKFPGASVL

SEQ ID NO: 4392 - protein, 41 aa, Homo sapiens
  SITE (30): Xaa equals any amino acid
  SITE (35): Xaa equals any amino acid
MLLVLTVFSFHKHCSGKLVLCAAGPFAYVXTINQXLNLKKK

SEQ ID NO: 4393 - protein, 8 aa, Homo sapiens
  SITE (2): Xaa equals any amino acid
  SITE (7): Xaa equals any amino acid
  SITE (8): Xaa equals any amino acid
VXPCGCXX

SEQ ID NO: 4394 - protein, 40 aa, Homo sapiens
  SITE (3): Xaa equals any amino acid
  SITE (27): Xaa equals any amino acid
  SITE (29): Xaa equals any amino acid
  SITE (33): Xaa equals any amino acid
  SITE (35): Xaa equals any amino acid
MLXLRLTIVIIHISVSADLSLQYFFSXLXNFLXLXVKPKC

SEQ ID NO: 4395 - protein, 37 aa, Homo sapiens
MKEMNDFCQSLFIQSSHSVNCFLIRSASARTVLTSII

SEQ ID NO: 4396 - protein, 91 aa, Homo sapiens
  SITE (13): Xaa equals any amino acid
  SITE (40): Xaa equals any amino acid
MEKTLFLYHYLPXLTFQILLLPVVLQHISDHLCRSQLQRXIFSALVVAWYSSACHVSNTLRPLTYGDKSLSPHELKALRWKDSWDILIRKH

SEQ ID NO: 4397 - protein, 361 aa, Homo sapiens
TRPDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 4398 - protein, 43 aa, Homo sapiens
FSYCLRVISLCKPLSFVLVFFSIMKLWYCTRSVVRCSLVSGLV

SEQ ID NO: 4399 - protein, 38 aa, Homo sapiens
MANLAALSLCFLLFSFLPLFPTLLSSLQSTTCTPGAPG

SEQ ID NO: 4400 - protein, 19 aa, Homo sapiens
MWLMMQLLSFFVFLCLLYL

SEQ ID NO: 4401 - protein, 19 aa, Homo sapiens
MWLMMQLLSFFVFLCLLYL

SEQ ID NO: 4402 - protein, 19 aa, Homo sapiens
MWLMMQLLSFFVFLCLLYL

SEQ ID NO: 4403 - protein, 134 aa, Homo sapiens
MEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVKSIHLEGDGQQLLDALQLELVTIQRLLGRT

SEQ ID NO: 4404 - protein, 35 aa, Homo sapiens
MPLMSLLVTVHFVVLSKCCANSKPFLKFFALIRVP

SEQ ID NO: 4405 - protein, 24 aa, Homo sapiens
MHINFLFSFYSTYQLHSVCFPKLV

SEQ ID NO: 4406 - protein, 39 aa, Homo sapiens
MDSLAWGGIFELHFLQCASPSQRIQGCHQLLLEGALCLV

SEQ ID NO: 4407 - protein, 12 aa, Homo sapiens
FFHICITICSFS

SEQ ID NO: 4408 - protein, 13 aa, Homo sapiens
MEAEEALLWILLQ

SEQ ID NO: 4409 - protein, 43 aa, Homo sapiens
MVNDSLLYFSFFFFFFLWFSSWIHPLILNQNVRSMNYELKYFS

SEQ ID NO: 4410 - protein, 17 aa, Homo sapiens
GIVLLIGVLVQVSAVDD

SEQ ID NO: 4411 - protein, 74 aa, Homo sapiens
MEQVHPGRTRTRLHCGLEIQGCQRFLLCAFLISWLPGGAPGCHSPLLWPYSIFHSNASLCGRSSDNSSDQDFKI

SEQ ID NO: 4412 - protein, 435 aa, Homo sapiens
MGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPMSTPKDSNPKA

SEQ ID NO: 4413 - protein, 32 aa, Homo sapiens
MKVLSFLLCIRISFLFVVESIVRGISKLNEVN

SEQ ID NO: 4414 - protein, 32 aa, Homo sapiens; identical to SEQ ID NO: 4413

SEQ ID NO: 4415 - protein, 27 aa, Homo sapiens
MLHIIQKLYPDHLFLFFIVKYLCFIHC

SEQ ID NO: 4416 - protein, 14 aa, Homo sapiens
MGITHEYLCVCVCV

SEQ ID NO: 4417 - protein, 105 aa, Homo sapiens
MWGAFWNTLLCPVSGAEGYRQSMPHKPAHPRDTSTLCPSCMYHWGRNLGSVFTTAAAWSHEFFPSAADSLQGGSSLPPPLLKLQSTGYGSGWFPQGSRYVGGEEN

SEQ ID NO: 4418 - protein, 36 aa, Homo sapiens
MKYSCLKGSYTVFMAILALLLVVCIFYQRKPVFRDG

SEQ ID NO: 4419 - protein, 21 aa, Homo sapiens
VGICLSFTQGWSWSFTCQFCL

SEQ ID NO: 4420 - protein, 29 aa, Homo sapiens
MDSATAPVAAGDCGQWWTLLLCTCCRLFL

SEQ ID NO: 4421 - protein, 30 aa, Homo sapiens
MWGGQRVCWAGFAFPAGATAVLTNEVCCQV

SEQ ID NO: 4422 - protein, 51 aa, Homo sapiens
GCEGLAILLSWVHVSDRNGAAWERSPSFTFSLLPPPPYSKTVPPTEGQGLL

SEQ ID NO: 4423 - protein, 30 aa, Homo sapiens
MIHLGFLLPLSLVWRRRDGIQWTEEFIFQG

SEQ ID NO: 4424 - protein, 30 aa, Homo sapiens
MIIQLVLSLPLFFLCCDSVTEYELVARVLW

SEQ ID NO: 4425 - protein, 6 aa, Homo sapiens
MTYMVA

SEQ ID NO: 4426 - protein, 39 aa, Homo sapiens
MAIEFYVFAFFVLIEIIPSSLSAYLMTPAFQIHRFTFSI

SEQ ID NO: 4427 - protein, 56 aa, Homo sapiens
MPNNLSLFYVFSLSFLSSFIPLIVTAKKMSVPVTLPPLFSLSPALWSGPWSTSNSP

SEQ ID NO: 4428 - protein, 44 aa, Homo sapiens
MHQNVLGRVSWLRIGLFELFQWALGHRGCPLLSGARAWGDEGRG

SEQ ID NO: 4429 - protein, 756 aa, Homo sapiens
ARVHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALMNNTQPKRIDLYLALLSAVSASIKDEKFFENYNQSLEKWSLSQAVTGLIDTGRISEAETLCTKNLKSNPDQPAVILLLRQVQCKPLPESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 4430 - protein, 81 aa, Homo sapiens
MAARVGAFLKNAWDKEPVLVVSFVVGGLAVILPPLSPYFKYSVMINKATPYNYPAAGEKGHRIELSSHSTQRQSCPGARRS

SEQ ID NO: 4431 - protein, 29 aa, Homo sapiens
MRLQSCSSQTAALLLSFYLPESCASQSPG

SEQ ID NO: 4432 - protein, 39 aa, Homo sapiens
MCTLLIFFLILPHWWLGTWEREQAFLHGPSLGCGEQRPM

SEQ ID NO: 4433 - protein, 39 aa, Homo sapiens; identical to SEQ ID NO: 4432

SEQ ID NO: 4434 - protein, 39 aa, Homo sapiens; identical to SEQ ID NO: 4432

SEQ ID NO: 4435 - protein, 32 aa, Homo sapiens
MHILNVCLYFFILNIIFVPLCFTSNIYLYKCV

SEQ ID NO: 4436 - protein, 10 aa, Homo sapiens
MCCCMRLHCC

SEQ ID NO: 4437 - protein, 92 aa, Homo sapiens
MRRRMRMLALWQQLLHPSGDPEQTQSWSVWKVPSSGGSCRCRSSGTQSSIGTRCSARWAGVVGSRPQHHGCQLPGWTKQGATSPFPRFQSSL

SEQ ID NO: 4438 - protein, 103 aa, Homo sapiens
MLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLEP

SEQ ID NO: 4439 - protein, 30 aa, Homo sapiens
MKAVGFVFLFTTILSHILLWAFVVYFKKTV

SEQ ID NO: 4440 - protein, 93 aa, Homo sapiens
MLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 4441 - protein, 46 aa, Homo sapiens
MLFRFVFIYLFGPAKLPSLQRPWTRIQPVPLCPTTLHSQRLAMQPT

SEQ ID NO: 4442 - protein, 161 aa, Homo sapiens
MWPGRIMTVTVVLLCCSTASIWPCLSHSASPSRTCPNFVGRSTRSCVTANSLCEPRTPDPKPINGKGDMGVPSQETPVPFLSCLFPLTSLWFFIFKCFNFCIFFSLREYLLISDVQGVATEKPLSSSVCRGVWPCGLGGAVILPLPRAGSRKSVLGVVGGQ

SEQ ID NO: 4443 - protein, 11 aa, Homo sapiens
MSPGGICNCII

SEQ ID NO: 4444 - protein, 57 aa, Homo sapiens
MWLLKPSAHSPVHVLVLLFPRGWSQPGTHKRQILVNAASLPGGCLLPWIWSGAALRF

SEQ ID NO: 4445 - protein, 68 aa, Homo sapiens
ICLRLCLCARHRLGAGALRLRRLWRGSETRGPAGGSLCVSRHCSPSHPGGSLEWVLQLPSWVRSEAGR

SEQ ID NO: 4446 - protein, 3 aa, Homo sapiens
ACV

SEQ ID NO: 4447 - protein, 27 aa, Homo sapiens
MNVIIVLVHALCPWCRGCPHWGPLVPP

SEQ ID NO: 4448 - protein, 34 aa, Homo sapiens
MQVQTTVLLLQADFFRVRAPCGELRAASIRAKPW

SEQ ID NO: 4449 - protein, 50 aa, Homo sapiens
MAQITWIHLLSVVICSAPPRRLHRQHSAVQAWAAHREHVQPSLTSSGRMP

SEQ ID NO: 4450 - protein, 26 aa, Homo sapiens
MRSPPHFIFFFLKCPGLGWGGQPPGV

SEQ ID NO: 4451 - protein, 50 aa, Homo sapiens
MGVRICGVQASCTCVHLCGVWVYLDCGLRLPYRTLLLPPPQGITGPCSSC

SEQ ID NO: 4452 - protein, 27 aa, Homo sapiens
MNIPIYVIGYLFLSSLELCTQTKTISG

SEQ ID NO: 4453 - protein, 12 aa, Homo sapiens
GFLFHLLHFFYF

SEQ ID NO: 4454 - protein, 43 aa, Homo sapiens
MEAFLHLWPDGSLGDWKSFSCHCYWGWAGPTCQEPRPGPKEAV

SEQ ID NO: 4455 - protein, 101 aa, Homo sapiens
MQGSGSQFRACLLCLCFSCPCSPGGPRWNSRQGGRRFPKTCRAISQNLVFKYKTFCPVRYMQPHRSSLCLHFTSYVFILSTWGSLRTYSTDLKKKKKKKKK

SEQ ID NO: 4456 - protein, 21 aa, Homo sapiens
MNTPGLSLFLLRISLLLMCGC

SEQ ID NO: 4457 - protein, 27 aa, Homo sapiens
MTIAIVILIIFPTVKNLALSSEIVMAL

SEQ ID NO: 4458 - protein, 37 aa, Homo sapiens
MFSRLYKQRLLLLLWYSHFGGGGSRLERISFALKSRM

SEQ ID NO: 4459 - protein, 47 aa, Homo sapiens
MMVPGGPAPLLLCFLFLLFWYLGELITKSLLRVMESYPSIPQAVFQR

SEQ ID NO: 4460 - protein, 47 aa, Homo sapiens
MFKDAGLFLLWGPFPGVPVSPSPGGSAPTRVGGISSQRLARPHLGEA

SEQ ID NO: 4461 - protein, 26 aa, Homo sapiens
MTVVLLLLHGITVYYVVGKYSLLNPT

SEQ ID NO: 4462 - protein, 26 aa, Homo sapiens
MTVVLLLLHGITVYYVVGKYSLLNPT

SEQ ID NO: 4463 - protein, 26 aa, Homo sapiens
MTVVLLLLHGITVYYVVGKYSLLNPT

SEQ ID NO: 4464 - protein, 26 aa, Homo sapiens
MTVVLLLLHGITVYYVVGKYSLLNPT

SEQ ID NO: 4465 - protein, 37 aa, Homo sapiens
MGMLFLLLCIHRSLVKANLPTQISKVVAIKTDTSQRK

SEQ ID NO: 4466 - protein, 19 aa, Homo sapiens
MAVFLYFDFCISILIFLVM

SEQ ID NO: 4467 - protein, 90 aa, Homo sapiens
PLLLALLSLALCRGRVVRVPTATLVRVVGTELVIPCNVSDYDGPSEQNFDWSFSSLGSSFVELASTWEVGFPAQHWPFGSIPVGFSEARW

SEQ ID NO: 4468 - protein, 40 aa, Homo sapiens [sequence omitted]

SEQ ID NO: 4469 - protein, 35 aa, Homo sapiens
MGTIRLLQIGLSLPFFTFLLANQSGFRKPFVICEK

SEQ ID NO: 4470 - protein, 32 aa, Homo sapiens
MELMNVRTRLWRVLSVRFLGFIHVVVYDLLPC

SEQ ID NO: 4471 - protein, 34 aa, Homo sapiens
MFTFISMFTFLVTLTCWLNTSNSPVEGSPPGRKG

SEQ ID NO: 4472 - protein, 74 aa, Homo sapiens
MNKTFHPLKHFPVLRFLFVFVVSSPCYPFCPFSLTMVIWSLGSYQSPRDILQSLSPFWVDFILFYFVFFKKITF

SEQ ID NO: 4473 - protein, 24 aa, Homo sapiens
GTRIWGVVCLFLEHRVAWPCWNDK

SEQ ID NO: 4474 - protein, 38 aa, Homo sapiens [sequence omitted]

SEQ ID NO: 4475 - protein, 59 aa, Homo sapiens
MLWSLASYIVNLAVKVLCLCKGRFVLVQNCPCLSKQVCLILSSISGGYCWHKLKVHPLT

SEQ ID NO: 4476 - protein, 65 aa, Homo sapiens [sequence omitted]

SEQ ID NO: 4477 - protein, 31 aa, Homo sapiens
MCWSSSVLFFFHWPVCLSFVYYHQAITLDSW

SEQ ID NO: 4478 - protein, 35 aa, Homo sapiens
MHICTFYLIILFWEIVICCFVCLLREARRRIYKCE

SEQ ID NO: 4479 - protein, 36 aa, Homo sapiens
MSQTWPHPFICYCLSWFCTTTAELNRCSRSFTEKVF

SEQ ID NO: 4480 - protein, 66 aa, Homo sapiens
MLKCGFMKYVVFLSVLVSFLEMCKSEKHTNHKSGIHHKPKKKKKKKKKKKKKKKKKKKKKKKKKKK

SEQ ID NO: 4481 - protein, 24 aa, Homo sapiens
MDFTVEGSSIHLWLLFNLVLLDFV

SEQ ID NO: 4482 - protein, 37 aa, Homo sapiens
MAQWHSGSSFLFFILGWNLKVVCSSGFGLIFEATLPS

SEQ ID NO: 4483 - protein, 35 aa, Homo sapiens
MLFFNLFCYLGSVLISGQIFTVLSQNITKRRVTTT

SEQ ID NO: 4484 - protein, 30 aa, Homo sapiens
FFFFSAFQHLFHGMSAQHFHELPQGYISTK

SEQ ID NO: 4485 - protein, 111 aa, Homo sapiens
WLLFRSLQRAPSWSFPSNLGTKTADLKGASELPTPCHECREDNDGEGHARPQSGMKPLTEGMRKNGTWLQATAATTRDCGVNPEEADSAFSLLATCSFYDHALHLWEWEGN

SEQ ID NO: 4486 - protein, 32 aa, Homo sapiens
KFQTAVIIFYFCHFSSSNRGPMQQEHKCEIMG

SEQ ID NO: 4487 - protein, 113 aa, Homo sapiens
  SITE (112): Xaa equals any amino acid
NSILHLPFWIELLKARTVLLTLSSSWCLAPRCSRNICMIELKLKVAVNLFEDYSGNSVYQRIKSLKSESTNSRRSWGMVPSKNRKDQKSQELTAYGGGGNNGLRRVDPQGLXN

SEQ ID NO: 4488 - protein, 172 aa, Homo sapiens
PVCGGFGVLWAWLCTGRWTLLWSSSFPYPGSDVGRLGGPVSSPPFALSCPFPLSPGRCLARLRPPSRQPGCELSLSLFPLVGKWPFPQHLLPGPRGTHLFWSSAWPSVSLGKGKEGWTALIRAGSVCSSGQPECQRCTGMWCVAPGPRHLCFGGFLPCLHTCQGRGDSKVGG

SEQ ID NO: 4489 - protein, 172 aa, Homo sapiens; identical to SEQ ID NO: 4488

SEQ ID NO: 4490 - protein, 34 aa, Homo sapiens
  SITE (17): Xaa equals any amino acid
MQGAGKALHELLLSAQXQGCLTAGVYESAKVLNV

SEQ ID NO: 4491 - protein, 68 aa, Homo sapiens [sequence omitted]

SEQ ID NO: 4492 - protein, 23 aa, Homo sapiens
KSFCLDLFSCSIFCKMYYIVSLL

SEQ ID NO: 4493 - protein, 65 aa, Homo sapiens
MMFITLPLPLQSYPALLILPQQTDAPGNNVGVSTKKFRRRKYIHVIQNCYLYHKIVKSLCSDFLL

SEQ ID NO: 4494 - protein, 19 aa, Homo sapiens
MDPRPLQAPIAIGSLKLSG

SEQ ID NO: 4495 - protein, 34 aa, Homo sapiens
MFSFISVLFCLFLLVSLRTIHLLFLHWLHLSCDI

SEQ ID NO: 4496 - protein, 35 aa, Homo sapiens
MFSFISVLFCLFLLVSFENNTPSIPSFGYTFPCDI

SEQ ID NO: 4497 - protein, 35 aa, Homo sapiens; identical to SEQ ID NO: 4496

SEQ ID NO: 4498 - protein, 14 aa, Homo sapiens
MAHWHVFYVFSCHS

SEQ ID NO: 4499 - protein, 32 aa, Homo sapiens
MWTSSSRGWGSFLNVCSLLPAWPSMQTLWLTS

SEQ ID NO: 4500 - protein, 47 aa, Homo sapiens
GLSRPTSSSPWPPGAMLLPLGSLCGPSSCLPVASVDQARASGQPFQA

SEQ ID NO: 4501 - protein, 19 aa, Homo sapiens
MGANILLSIATITIGWLWI

SEQ ID NO: 4502 - protein, 31 aa, Homo sapiens
MKFTLMLVMSLELSLRKVLSSVYPLGKYNHE

SEQ ID NO: 4503 - protein, 31 aa, Homo sapiens
MDLSSPTILIIFSGCVSAFLCHIKHCIRNQK

SEQ ID NO: 4504 - protein, 39 aa, Homo sapiens
MIMMRRRKILIFLKILILMKMKGDCLEVKNLSQVKVPEI

SEQ ID NO: 4505 - protein, 10 aa, Homo sapiens
MSCSFLEFSI

SEQ ID NO: 4506 - protein, 17 aa, Homo sapiens
TILFSLLLGFSITKKQI

SEQ ID NO: 4507 - protein, 17 aa, Homo sapiens
TILFSLLLGFSITKKQI

SEQ ID NO: 4508 - protein, 29 aa, Homo sapiens
MAFCFCFFLHPSETAPLCGRQGMGFSPGH

SEQ ID NO: 4509 - protein, 41 aa, Homo sapiens
MALTSVLLFILLFFGVILMCLLRAFYLPDFSWLTFGLYFAP

SEQ ID NO: 4510 - protein, 15 aa, Homo sapiens
MQSLFYSLLLIRVSG

SEQ ID NO: 4511 - protein, 35 aa, Homo sapiens
MAPPGLAVFLLWVLMPPGPTASSQPRAAAPPVSFS

SEQ ID NO: 4512 - protein, 26 aa, Homo sapiens
MLTSGFIFQKIWLLCGEWTMLGQKTK

SEQ ID NO: 4513 - protein, 33 aa, Homo sapiens
MNILIKRILVLAQLMHISDSHICCINWFNTFGT

SEQ ID NO: 4514 - protein, 3 aa, Homo sapiens
LVY

SEQ ID NO: 4515 - protein, 31 aa, Homo sapiens
MVLLILFIHCPLVRCYRILMNAFCIVVFHTS

SEQ ID NO: 4516 - protein, 38 aa, Homo sapiens
MWYLTFSKHFLLLGFPVPFSDGELTVPIEIFIFITILT

SEQ ID NO: 4517 - protein, 33 aa, Homo sapiens
MRQMSLNWKDILTLLCVLTACFWTSTEPALLMQ

SEQ ID NO: 4518 - protein, 80 aa, Homo sapiens
MWGRRQCALWMVFTSTAHTTLGSRPSTKQESARTARPWSSKRLRVRPFSSIPQSENCVASKVAGKPGGNPTTAHIPEVFP

SEQ ID NO: 4519 - protein, 35 aa, Homo sapiens
MVEPGGATMGAGPGSCILLSLLPLARTCLSGDFGL

SEQ ID NO: 4520 - protein, 21 aa, Homo sapiens
MIMGALIRTLDTFVIVFNICI

SEQ ID NO: 4521 - protein, 38 aa, Homo sapiens
MHISYLHSSYVSGAIVWLLSLSVWFHHQSIHPYIKLKI

SEQ ID NO: 4522 - protein, 83 aa, Homo sapiens
MQFHASVPSLMLFLPTGMPSPAPPALSAWQVHLSRSPQRPPPPGRQPLCPSPPGYLCTLSMLLLWHLSHCILLVYMFVSPSRL

SEQ ID NO: 4523 - protein, 98 aa, Homo sapiens
MTRRLRRLSGCRCTPGLGASLPGPGGSWVAWLQGKTGARTHVSPAGVGGAAALGSGVRPWGMFPMVGSLARPEKTCSRASIRCPLEEAELFEGCCKVR

SEQ ID NO: 4524 - protein, 36 aa, Homo sapiens
MLRVDLFTFSFNFTLTEFFFPNQTNSLASVAFSSLR

SEQ ID NO: 4525 - protein, 14 aa, Homo sapiens
NGIAALIWQLCLAF

SEQ ID NO: 4526 - protein, 24 aa, Homo sapiens
MRPIGPSEPFCGCTWGPLWTMGCG

SEQ ID NO: 4527 - protein, 49 aa, Homo sapiens
MPWGNCYVISHLQGSILIQFLLNIQLGCRDIDISFELSEFFIFISKNLI

SEQ ID NO: 4528 - protein, 48 aa, Homo sapiens
MSSISFLLHFLHVLPLWAPLVSLSPLLPVPHLFAVLVEAEVWAAKIWM

SEQ ID NO: 4529 - protein, 41 aa, Homo sapiens
MCRIHLNICKKLQGEELFFVFLFLFVLFFCHFTNWPHDRLR

SEQ ID NO: 4530 - protein, 32 aa, Homo sapiens
MQLCSGVLNPGLISNLFSSHSSQLFCAVHLGS

SEQ ID NO: 4531 - protein, 36 aa, Homo sapiens
MHGLVCFLGFSVSLSCFAFQRSCSYQGITQPLKLSS

SEQ ID NO: 4532 - protein, 56 aa, Homo sapiens
MRIAVLLMTYHSSCMGKQSRKQCPKWKKDTHTEQNSSWSCSWSCQTLPDALSKVKI

SEQ ID NO: 4533 - protein, 23 aa, Homo sapiens
MGLFLLFLLRVGVGCVICKYFCA

SEQ ID NO: 4534 - protein, 136 aa, Homo sapiens
MIQNILFLSAFFWGEGPIIPTLPHTVKSCPLWEPGSFPQNVSRSLEDDPSSTPHACSMGQCPQLPAFPLTMEPGTPGKPGAPRRPRSSRVASLSCRARWPNRPHGTTLARSTRHAGSPLLSCLALLSCSSWITLQR

SEQ ID NO: 4535 - protein, 33 aa, Homo sapiens
MPLSYSFCVLFIVWCIHSWKICNSCVSRICVFT

SEQ ID NO: 4536 - protein, 33 aa, Homo sapiens; identical to SEQ ID NO: 4535

SEQ ID NO: 4537 - protein, 20 aa, Homo sapiens
MLCVCLSTAISATFSLMHVE

SEQ ID NO: 4538 - protein, 8 aa, Homo sapiens
MSAWCNFY

SEQ ID NO: 4539 - protein, 35 aa, Homo sapiens
MCSGNGAACICRAQVLLALCCGICTSPAICCPWAT

SEQ ID NO: 4540 - protein, 13 aa, Homo sapiens
MGSCLLPNVYFSC

SEQ ID NO: 4541 - protein, 32 aa, Homo sapiens
MMFLIIMVITTVLFSDESVRSPGTCEYVVFDL

SEQ ID NO: 4542 - protein, 14 aa, Homo sapiens
FFTFPSAAHTAIQQ

SEQ ID NO: 4543 - protein, 31 aa, Homo sapiens
  SITE (23): Xaa equals any amino acid
MCMCVHVCACMCVPMCMCACRCXCVCLCVCT

SEQ ID NO: 4544 - protein, 187 aa, Homo sapiens
MVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVHPIIPKATSFPKDGSFPRSPATTSGQLLLSCISKDAPGVWSSQRSFQL

SEQ ID NO: 4545 - protein, 25 aa, Homo sapiens
MESLCCRVHTSRICLMNGVCLLYWS

SEQ ID NO: 4546 - protein, 21 aa, Homo sapiens
MKDLLSQAHETSSEEAVLFLY

SEQ ID NO: 4547 - protein, 27 aa, Homo sapiens
LMLTARFVQCTVVDPSAGFLIWIQARA

SEQ ID NO: 4548 - protein, 6 aa, Homo sapiens
LYLCGS

SEQ ID NO: 4549 - protein, 93 aa, Homo sapiens
QNTLTRFMRLPLISVALVQGWALGGGAEFTTACDFRLMTPESKIRFVHKEMGIIPSWGGTTRLVEIIGSRQALKVLSGALKLGFKKCSKHRNG

SEQ ID NO: 4550 - protein, 12 aa, Homo sapiens
MFLVVVVVLAFN

SEQ ID NO: 4551 - protein, 13 aa, Homo sapiens
IYLFQFTLSFCCF

SEQ ID NO: 4552 - protein, 39 aa, Homo sapiens
PFSLPPFSNCWYVSIVPSPHMQEAARILEIAAWSSETLP

SEQ ID NO: 4553 - protein, 62 aa, Homo sapiens
MTILQVVALPLYLYIILTWHLWPFLCSYVSVFPGRVYALECQELVSLVFFIYLAYKILLRIW

SEQ ID NO: 4554 - protein, 30 aa, Homo sapiens
MEFFETLGLNDSSELSLLFDTKEWHVWGFL

SEQ ID NO: 4555 - protein, 24 aa, Homo sapiens
  SITE (22): Xaa equals any amino acid
MACKLKLFTIWCFTGKALPTSXFN

SEQ ID NO: 4556 - protein, 45 aa, Homo sapiens
MLWEVCSFAFCNIACCCSLFGFVPPLSAVTLTAKSATSLLRPARP

SEQ ID NO: 4557 - protein, 136 aa, Homo sapiens [sequence omitted]

SEQ ID NO: 4558 - protein, 19 aa, Homo sapiens
MPLLFMSLTLLWQSGCSRK

SEQ ID NO: 4559 - protein, 26 aa, Homo sapiens
AVPHPNLIWNCSSHNSHTSWDGPGER

SEQ ID NO: 4560 - protein, 14 aa, Homo sapiens
MRSLPFYFLLCCFL

SEQ ID NO: 4561 - protein, 4 aa, Homo sapiens
MRKA

SEQ ID NO: 4562 - protein, 8 aa, Homo sapiens
MCAAEPYF

SEQ ID NO: 4563 - protein, 36 aa, Homo sapiens
  SITE (17): Xaa equals any amino acid
  SITE (34): Xaa equals any amino acid
MVNFFCFVLLRRVSSLXKKKKKSERHERCKEAQXWL

SEQ ID NO: 4564 - protein, 21 aa, Homo sapiens
MSFHMIVILLQSITKDSTILV

SEQ ID NO: 4565 - protein, 26 aa, Homo sapiens
MQAQFKTPAYSKVSVLILTHCILWVW

SEQ ID NO: 4566 - protein, 26 aa, Homo sapiens
MLNVKHMPNISLVLFVTFFPQYFRVI

SEQ ID NO: 4567 - protein, 30 aa, Homo sapiens
MHSRKPVRVLSILQLVLGLYPSCKDVMPQK

SEQ ID NO: 4568 - protein, 21 aa, Homo sapiens
MQRFVGLCGNIIIIWPCVAMS

SEQ ID NO: 4569 - protein, 9 aa, Homo sapiens
FHLYSLLLV

SEQ ID NO: 4570 - protein, 25 aa, Homo sapiens
MAQESLSPLGLLILVCAEPSVCAEG

SEQ ID NO: 4571 - protein, 34 aa, Homo sapiens
MKCISMAILFWIYGGSRAFLTLKVVCVREKAFTA

SEQ ID NO: 4572 - protein, 21 aa, Homo sapiens
FLCMFFLQTLQRCDYTIVYKQ

SEQ ID NO: 4573 - protein, 21 aa, Homo sapiens
FLCMFFLQTLQRCDYTIVYKQ

SEQ ID NO: 4574 - protein, 78 aa, Homo sapiens
MQFLKNVRCFTFSFSHLVFNIWCVFYTSSTSQFTPATFKMLSSRMQLVQPYLGPVSAWGRAGELSCVHGGPGEPPVLC

SEQ ID NO: 4575 - protein, 11 aa, Homo sapiens
MSSLHTTITVF

SEQ ID NO: 4576 - protein, 34 aa, Homo sapiens
MGLTGPFTFIYLLFEILSGQTTEPQINYFLTKFW

SEQ ID NO: 4577 - protein, 28 aa, Homo sapiens
MRFSKNVIWVHNFILLWSDNSPCEISAF

SEQ ID NO: 4578 - protein, 16 aa, Homo sapiens
DPPCPASIPTILYSTL

SEQ ID NO: 4579 - protein, 73 aa, Homo sapiens
MAPRPHLLTVLLLLPLGLNPKASLQWGGPCLGKAGASSPLVPLLLWRVSCEVSVIPKVKFAGLNDSVCPASLC

SEQ ID NO: 4580 - protein, 91 aa, Homo sapiens [sequence omitted]

SEQ ID NO: 4581 - protein, 32 aa, Homo sapiens
MGLKGAALCLFITWVHCILVVTGFPVYSSPTQ

SEQ ID NO: 4582 - protein, 39 aa, Homo sapiens
MEIGFFLLFFLLRYTANPETTTFLNSSSLAVQTIFCFQM

SEQ ID NO: 4583 - protein, 29 aa, Homo sapiens
MFLNRLKLLYGFWLIIINTVNYTRQPTRS

SEQ ID NO: 4584 - protein, 62 aa, Homo sapiens
  SITE (19): Xaa equals any amino acid
MLQKEVRQQILIVLMTFKXTYIRESLFSTFFRQNLLLSLHNIYQVFSGMEGEKSKLTLLNIF

SEQ ID NO: 4585 - protein, 76 aa, Homo sapiens
MNSEVECMPFTSVHILPDFLLGCLHTSLTFLLLNLPLCMVLLPPFNRLDVLTSAYCILHPHTSCQVFPYTGSILHS

SEQ ID NO: 4586 - protein, 70 aa, Homo sapiens
MLLYVSVQTPCLLIFCVDVLLTIESGSFQPPAMIRATPYFLQFHQWLLHIFWDSVFDFGTYIFKIIVSPC

SEQ ID NO: 4587 - protein, 34 aa, Homo sapiens
MNGNHAWISWAFSMLFFPSPLPGIYSKLTYNSEN

SEQ ID NO: 4588 - protein, 54 aa, Homo sapiens [sequence omitted]

SEQ ID NO: 4589 - protein, 44 aa, Homo sapiens
MLNGGGELGILHLFLIILDISLLEEKLSVTTEHKVDFSLSSPIF

SEQ ID NO: 4590 - protein, 7 aa, Homo sapiens
MAPKAWP

SEQ ID NO: 4591 - protein, 361 aa, Homo sapiens
  SITE (303): Xaa equals any amino acid
MWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLXLDEYMRFLNCRKGRKDPSKSILDVGVEEAIKFSGFDEKMFLKRGGKYIWSKADLKLDW

SEQ ID NO: 4592 - protein, 37 aa, Homo sapiens
MNVCFVLFLLYCLLDLGCFPLSVRTVNVDMKVHSPVE

SEQ ID NO: 4593 - protein, 33 aa, Homo sapiens
MVLLVQADCFSLLMNIAWLLIISYLEGSLGEQF

SEQ ID NO: 4594 - protein, 104 aa, Homo sapiens
  SITE (99): Xaa equals any amino acid
  SITE (103): Xaa equals any amino acid
MLSPWWGSDCFLELALFFSASELSLLPLALSIFPIYICLSRFKFYLLQDANHNFPIKCNLLVFASPTVLCQKCSPRGTENYSFLQCGCSHPPFFLPFCXQTPXR

SEQ ID NO: 4595 - protein, 399 aa, Homo sapiens
MLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 4596 - protein, 23 aa, Homo sapiens
MGLAQVVLPAVAHMSLAPVTLLA

SEQ ID NO: 4597 - protein, 39 aa, Homo sapiens
MAFFCSCGSRAVETSWVFLLILCQPPGAVCTGVGHLAPF

SEQ ID NO: 4598 - protein, 61 aa, Homo sapiens
MWLFRSLSGLFTDILASPQLSLTKGYSQKWSPYFPSSNDYLPGGRSSSVHSICFRTYAQRL

SEQ ID NO: 4599 - protein, 48 aa, Homo sapiens
MSILSVSHFEDFFSLLYLCFSFFGFYFVVLSVIFNVPKICTCSIKNVV

SEQ ID NO: 4600 - protein, 71 aa, Homo sapiens
MAGMALARAWKQMSWFYYQYLLVTALYMLEPWERTVFNSMLVSIVGMALYTGYVFMPQHIMAILHYFEIVQ

SEQ ID NO: 4601 - protein, 7 aa, Homo sapiens
ELFILQI

SEQ ID NO: 4602 - protein, 60 aa, Homo sapiens [sequence omitted]

SEQ ID NO: 4603 - protein, 71 aa, Homo sapiens [sequence omitted]

SEQ ID NO: 4604 - protein, 30 aa, Homo sapiens
MTVCGSFAIFLCIKSAIVAASEHACIPTDI

SEQ ID NO: 4605 - protein, 32 aa, Homo sapiens
MHLSNACLVFVLQTCLWWRVVSCSPVRLKAAL

SEQ ID NO: 4606 - protein, 34 aa, Homo sapiens
MTMFFSTWKIATLCSTFSQPQPWSTITMKKKNMP

SEQ ID NO: 4607 - protein, 28 aa, Homo sapiens
MCTAGIAELLTWILVLAFLLLQFQYLHL

SEQ ID NO: 4608 - protein, 42 aa, Homo sapiens
MYLVIFSCCPLGVFPFFSHVNIFHRYPCSLLNLQAHTMLHRS

SEQ ID NO: 4609 - protein, 30 aa, Homo sapiens
MVIVLYINIEHCCDCSRTFYVTALKQRHDY

SEQ ID NO: 4610 - protein, 26 aa, Homo sapiens
GQLRWSSLVSQFACLFILFSAKCIPF

SEQ ID NO: 4611 - protein, 37 aa, Homo sapiens
MVFTFDLFGILLTSGILGRHFFYSSAYEFKAIFCKYF

SEQ ID NO: 4612 - protein, 72 aa, Homo sapiens [sequence omitted]

SEQ ID NO: 4613 - protein, 39 aa, Homo sapiens
CASSPFLSLGPPRHTISVKGLSSPHGLLSQPFPLWQPWG

SEQ ID NO: 4614 - protein, 28 aa, Homo sapiens
FGFGGCFFVVAWFGIFGFVCICINFLYN

SEQ ID NO: 4615 - protein, 48 aa, Homo sapiens
MMGWRILAIGAVLTAAGRLGFPLPSLILVLYPPFHSSPDSLSSSSLYL

SEQ ID NO: 4616 - protein, 21 aa, Homo sapiens
MKLEFFWIFLVICWCVLSSDT

SEQ ID NO: 4617 - protein, 36 aa, Homo sapiens
MCLCCFLLKNCQRSGEGNDRSRKAPHHCVVRQYTER

SEQ ID NO: 4618 - protein, 54 aa, Homo sapiens
MKVVLMLLFICLGNMYLHGLRNLWQILFHIGVAFLSSYQILTRQLQEKQSDCGV

SEQ ID NO: 4619 - protein, 116 aa, Homo sapiens
MVRGPICYSFPPAPLFQFWLLLVSLRYLQPPWLGNHRSAQLSPWSPVSQSLVLPGPPHPHPQEPQPFLRGFQKDSLWRLFLLTFESSPFQFSFTRSNCTQAVLKIGNAFIYTKPFP

SEQ ID NO: 4620 - protein, 32 aa, Homo sapiens
MRLFLCLWSNPAWGKVSISDTIDVFYSALNFI

SEQ ID NO: 4621 - protein, 46 aa, Homo sapiens
MHNLMLILISLFILQISKDKGIFCFVLILARLRGTRHSYTLLGMNR

SEQ ID NO: 4622 - protein, 42 aa, Homo sapiens
MSLGETLLITTYVPVFLLLGVPGCRPPLGKAVTGRCSSTFLD

SEQ ID NO: 4623 - protein, 36 aa, Homo sapiens [sequence omitted]

SEQ ID NO: 4624 - protein, 51 aa, Homo sapiens [sequence omitted]

SEQ ID NO: 4625 - protein, 106 aa, Homo sapiens
MLFTLLVSCYVFLPLALPCFAFFFSFWPIPFYMCPQQRWGDTEHPGSFPALLGRPRLQAPAVETLKGNKQPSTLPDPRLFREAAHFHPGPRTPSLCPTRISLNGRD

SEQ ID NO: 4626 - protein, 36 aa, Homo sapiens
MTFVCKWLLGLEMAWFLFFFFFFLSSSRWEGGLRVL

SEQ ID NO: 4627 - protein, 18 aa, Homo sapiens
GSCLKLTQFKYSFCKTDF

SEQ ID NO: 4628 - protein, 62 aa, Homo sapiens
MGFSLFFLFFLPPFAVFPDLHLLKSKCTFLGLSKCRSFMLSYHTPTECRSHTAKALACHIVM

SEQ ID NO: 4629 - protein, 30 aa, Homo sapiens
MVVAYGRVFMLYLSLLFNFYQIKGSKNINL

SEQ ID NO: 4630 - protein, 18 aa, Homo sapiens
MQQIKFVVFAFQGVTGCP

SEQ ID NO: 4631 - protein, 54 aa, Homo sapiens
MLIQMEKTGEGVGVTVQYFLALGLLLSQFLSLPLLIISGMLAVINPISMMNGLG

SEQ ID NO: 4632 - protein, 10 aa, Homo sapiens
MFVYCIHFHS

SEQ ID NO: 4633 - protein, 7 aa, Homo sapiens
MQSIKRT

SEQ ID NO: 4634 - protein, 34 aa, Homo sapiens [sequence omitted]

SEQ ID NO: 4635 - protein, 45 aa, Homo sapiens
MRGLYFCLGVVICTHAILLKPSCLVLFLESFFFPVLMYAGFGNSS

SEQ ID NO: 4636 - protein, 2 aa, Homo sapiens
MG

SEQ ID NO: 4637 - protein, 44 aa, Homo sapiens
MIFHLSNLLLDTICTFLFSCSQGGGLQGPELCYPTRFLIEIPNH

SEQ ID NO: 4638 - protein, 37 aa, Homo sapiens
MLGIVISCLFYCWTKWEAKEVCQRRWRVRRYHLSKIS

SEQ ID NO: 4639 - protein, 31 aa, Homo sapiens
MILDTKMWVLSILVAVGVLIASRASQDRARK

SEQ ID NO: 4640 - protein, 22 aa, Homo sapiens
MVFIFISTCQLCISKTAGFSKE

SEQ ID NO: 4641 - protein, 30 aa, Homo sapiens
MLEMLLRLLRAIWANVFLWHFYFTNSISSI

SEQ ID NO: 4642 - protein, 756 aa, Homo sapiens
MSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQEPQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 4643 - protein, 1 aa, Homo sapiens
F

SEQ ID NO: 4644 - protein, 7 aa, Homo sapiens
KILDFHS

SEQ ID NO: 4645 - protein, 35 aa, Homo sapiens
APSISTGSPSIANLFLTGLLGPEVLHLKHPMLKAA

SEQ ID NO: 4646 - protein, 32 aa, Homo sapiens
MFARCSLLLISFLLFTARFSQVRGHQPWPPFP

SEQ ID NO: 4647 - protein, 17 aa, Homo sapiens
MPLSCYFKLWPSIALSL

SEQ ID NO: 4648 - protein, 34 aa, Homo sapiens
MRKYCLGFCYSVFILGRVLNFMHLHLLACGCAKC

SEQ ID NO: 4649 - protein, 37 aa, Homo sapiens
KTIHSYLFFFSPYCLSQLTLYTDFVSPSIPFTPDYKF

SEQ ID NO: 4650 - protein, 28 aa, Homo sapiens
MKGFFLIVFMLSRAEEEEDEGLVLLSCG

SEQ ID NO: 4651 - protein, 31 aa, Homo sapiens
MIRHLRNTGALLLFSLQLVWADKREIEPSHS

SEQ ID NO: 4652 - protein, 1 aa, Homo sapiens
I

SEQ ID NO: 4653 - protein, 17 aa, Homo sapiens
MRGSSQLCLVLLLPAAL

SEQ ID NO: 4654 - protein, 9 aa, Homo sapiens
MWGRSFLQL

SEQ ID NO: 4655 - protein, 16 aa, Homo sapiens
GHTEGIAVVSHFGFLL

SEQ ID NO: 4656 - protein, 34 aa, Homo sapiens
MDLFGFRALLSFHWNVLFALALFFFFFWFLLAFI

SEQ ID NO: 4657 - protein, 46 aa, Homo sapiens
MTRRHIVLLREFWHWERCRLSRMTAIPTPQSVLRDCGEGASGTGKV

SEQ ID NO: 4658 - protein, 126 aa, Homo sapiens [sequence omitted]

SEQ ID NO: 4659 - protein, 66 aa, Homo sapiens
MALILIVFKYQSFFRLHSCNQQPHAKVLEPAVELQDEDGMVHLSTVISYNLKNRQAGNVYIESYIP

SEQ ID NO: 4660 - protein, 49 aa, Homo sapiens
DQRQWLGVMCELSLLLRMLFCERNCECNGNVGASGDSLSCPLTSKASCA

SEQ ID NO: 4661 - protein, 69 aa, Homo sapiens [sequence omitted]

SEQ ID NO: 4662 - protein, 38 aa, Homo sapiens
MSIFSVLIFFPSHCYSLPSRVRCGEIMLACFHGDTEEK

SEQ ID NO: 4663 - protein, 19 aa, Homo sapiens
MACIPSGLLIWAWNLWFRA

SEQ ID NO: 4664 - protein, 84 aa, Homo sapiens [sequence omitted]

SEQ ID NO: 4665 - protein, 36 aa, Homo sapiens
MCYFLVISIILCIFRLFNSQMYMILPCFLKKNLSIM

SEQ ID NO: 4666 - protein, 20 aa, Homo sapiens
MKAVWYLASSFLIFLVVQKR

SEQ ID NO: 4667 - protein, 27 aa, Homo sapiens
MIRTVIFSTLFLYSVPGMTYSIDFMTH

SEQ ID NO: 4668 - protein, 32 aa, Homo sapiens
TFLFLFWYCKLAGWLHWLTHYPLHHILFFTYY

SEQ ID NO: 4669 - protein, 39 aa, Homo sapiens
MYIIISLTLIMWRFRFFQLMRLQPCLCLKKMKKQNKTMS

SEQ ID NO: 4670 - protein, 36 aa, Homo sapiens
MGLSGPGGSQHSLHFLTSSSFLIFFSFFSIETGAEA

SEQ ID NO: 4671 - protein, 77 aa, Homo sapiens [sequence omitted]

SEQ ID NO: 4672 - protein, 26 aa, Homo sapiens
MSPFFLTVLKHYFAFLFVTKSFIFNG

SEQ ID NO: 4673 - protein, 10 aa, Homo sapiens
MLKSDAVKAI

SEQ ID NO: 4674 - protein, 31 aa, Homo sapiens
  SITE (27): Xaa equals any amino acid
MYYVQKTNPLVIAMGTVSINFFFFYKXRKVY

SEQ ID NO: 4675 - protein, 39 aa, Homo sapiens
MYICLIILLSTVFCGPDSAFLCFFGFRLLVACDFSDFWP

SEQ ID NO: 4676 - protein, 42 aa, Homo sapiens [sequence omitted]

SEQ ID NO: 4677 - protein, 80 aa, Homo sapiens
ISSTDIWWNRSLDTGLRLLLSWPGAAGTTACVCADTVYYYQMVPSWKFRSPPTWISLLGPFSGSFNVDNDSGMWLYLLLY

SEQ ID NO: 4678 - protein, 37 aa, Homo sapiens
MLIFQIISQQLPYLLLAITTGSQESRYFYSCWTNEKK

SEQ ID NO: 4679 - protein, 30 aa, Homo sapiens
MTPCTLSFPVFLIYIISKYLWLLSSCSPEP

SEQ ID NO: 4680 - protein, 38 aa, Homo sapiens
MTCARSPLALPTPLFFFLLILYSQKRISFSSFFHSLKF

SEQ ID NO: 4681 - protein, 5 aa, Homo sapiens
GKCAC

SEQ ID NO: 4682 - protein, 77 aa, Homo sapiens
MQKQLYFRAWCYLLANFLFFDLTATTFDSTSLKTSARSRQYTLTTLVLTAFPIASLPFKLLLVSVLPSDWSKHNKGL

SEQ ID NO: 4683 - protein, 28 aa, Homo sapiens
MRPYQRKNRTLAFFLRFLIMFLVFCESL

SEQ ID NO: 4684 - protein, 34 aa, Homo sapiens
MATILILSMHLHLLQASSKGLCFCTLPSTFLYDF

SEQ ID NO: 4685 - protein, 66 aa, Homo sapiens
MTLPSWFSCYLSDCPLRGPLSPPVLSFLVSLKGLVMGLRPSKYAPGFNYHLYAAESKSIQLVLNCT

SEQ ID NO: 4686 - protein, 33 aa, Homo sapiens
MVVMEAGGIMPCWFQCWDWLLFVGFGLGSPRKK

SEQ ID NO: 4687 - protein, 34 aa, Homo sapiens
KWLLFIFLLCLQLVNALLSLFQERFVHCPARFVS

SEQ ID NO: 4688 - protein, 29 aa, Homo sapiens
MQLAVFAFSTLWLWLLAMPRLSVGMPYGS

SEQ ID NO: 4689 - protein, 39 aa, Homo sapiens
MRWLLLVFNQIRFTVISLICIYYLFAIILYRIFWIHVLA

SEQ ID NO: 4690 - protein, 30 aa, Homo sapiens
MAFFKVSYHFLIALLTYNWTQPTLSASVNS

SEQ ID NO: 4691 - protein, 38 aa, Homo sapiens
MARADWVLSLLLYNHITALPCIFSSKNGDYLLCGSVCR

SEQ ID NO: 4692 - protein, 6 aa, Homo sapiens
MFIIKI

SEQ ID NO: 4693 - protein, 22 aa, Homo sapiens
HCLHQKQFLFFFLILLLLYLKF

SEQ ID NO: 4694 - protein, 28 aa, Homo sapiens
PRTPCNVGRPALSSMALTSCSGRTSSPG

SEQ ID NO: 4695 - protein, 16 aa, Homo sapiens
MGSSRGREASWGLPLG

SEQ ID NO: 4696 - protein, 74 aa, Homo sapiens
FRFLFSFFHEALWRSMFLLSFLRKPSFWATGLILSTSSFPPFSIVSLPPSHPTPCPSLPQLPLFPCSEFPAQRH

SEQ ID NO: 4697 - protein, 27 aa, Homo sapiens
MCLFLFCLFYFYFSVNARTDLHVKSGL

SEQ ID NO: 4698 - protein, 25 aa, Homo sapiens
GHPKCKLLLSDPCLLMYSLFNCVEF

SEQ ID NO: 4699 - protein, 40 aa, Homo sapiens
MACVILGFCVFWWVSFLGSPDLLLGPVLSANPASFTCPAH

SEQ ID NO: 4700 - protein, 36 aa, Homo sapiens
MWVREGIWFCYLAVVFSHPSFLTIKSHLGLEKKKKK

SEQ ID NO: 4701 - protein, 433 aa, Homo sapiens
  SITE (298): Xaa equals any amino acid
MATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMXIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 4702 - protein, 38 aa, Homo sapiens
MGSPMTWSCRSLSSLWWPPVSSARHRRCSRRGDPGTRG

SEQ ID NO: 4703 - protein, 39 aa, Homo sapiens; identical to SEQ ID NO: 3234

SEQ ID NO: 4704 - protein, 28 aa, Homo sapiens
MIGLTFASTSDFALLSKFNTFQLLMCVL

SEQ ID NO: 4705 - protein, 31 aa, Homo sapiens
MGKGIAVLALWYAATSLGSRPCPCPTTHSQL

SEQ ID NO: 4706 - protein, 17 aa, Homo sapiens
MLLFLIVTLLMNVRSLG

SEQ ID NO: 4707 - protein, 50 aa, Homo sapiens
MFLLFPQTSLTVLFVSCPVEGSRVHILLSVNMPWNLHKGRTMCSFFQQLF

SEQ ID NO: 4708 - protein, 65 aa, Homo sapiens
MHRLALWLLGLWGVMWSHTSALLALVKLWKGRLGKAGTRKKRKRQQQESMQVGKNLVWRAQQRKR

SEQ ID NO: 4709 - protein, 34 aa, Homo sapiens
MERVGRNLTALRFLLFVLILRLLKIIFICSVYYE

SEQ ID NO: 4710 - protein, 43 aa, Homo sapiens
MCESTELNMTFHLFIVALAGAGARNSDRNTTRVNGSQPCSDPQ

SEQ ID NO: 4711 - protein, 55 aa, Homo sapiens
MTQKDGICKDQLLFALLIVCNAVYSNTWSFSSGSGMWINLTNQDPSLNVNTTNYT

SEQ ID NO: 4712 - protein, 24 aa, Homo sapiens
MNCKKQLLTDIFLLLFLGGFFFFF

SEQ ID NO: 4713 - protein, 53 aa, Homo sapiens
MRFLAHVLCSFSVVFLHLKNSHGSMFYKMNYQRNRDGPRFSEMVPCDQVLLFG

SEQ ID NO: 4714 - protein, 35 aa, Homo sapiens
MDLFCSFLPSLLAIMFLCPPVLHFMGYHVQQQLRR

SEQ ID NO: 4715 - protein, 11 aa, Homo sapiens
MSHCVWSLAVS

SEQ ID NO: 4716 - protein, 28 aa, Homo sapiens
MPEWWGQMLWTLGPAALPLLAGRCTREV

SEQ ID NO: 4717 - protein, 38 aa, Homo sapiens
MFGNSSCSTYLLWVSLFNFGHSSECIMISCYGFKFAFS

SEQ ID NO: 4718 - protein, 66 aa, Homo sapiens; identical to SEQ ID NO: 3971

SEQ ID NO: 4719 - protein, 36 aa, Homo sapiens
MFCHCIVCLLLVLWSSLPFFIPSFLLLKVILSCGMI

SEQ ID NO: 4720 - protein, 25 aa, Homo sapiens
MMTLGLSLFLFFCFVGCEFERFCDK

SEQ ID NO: 4721 - protein, 38 aa, Homo sapiens
MDFTKLLTYTFGFAVFIVLGKNCGFKNYSLIKLLKKKK

SEQ ID NO: 4722 - protein, 33 aa, Homo sapiens
MFIGDSAYIFITYLLFWLLSNILSFVFANSVHE

SEQ ID NO: 4723 - protein, 32 aa, Homo sapiens
MLKILMCKSPLSPHLFYKLLWLEGFCFWLLSG

SEQ ID NO: 4724 - protein, 406 aa, Homo sapiens
  SITE (254): Xaa equals any amino acid
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVRXKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKKK

SEQ ID NO: 4725 - protein, 58 aa, Homo sapiens
MPFCMNACEMLLLLCMAWLPWLAGISSFVVFLSSLCITVSFVFLACKLLEDKGMSESI

SEQ ID NO: 4726 - protein, 14 aa, Homo sapiens
NILFVLIDSILGSS

SEQ ID NO: 4727 - protein, 37 aa, Homo sapiens
MVWICVLLQTLLRHILRSMERNRVDDKVCVVFTKEYS

SEQ ID NO: 4728 - protein, 410 aa, Homo sapiens
  SITE (8): Xaa equals any amino acid
  SITE (404): Xaa equals any amino acid
  SITE (409): Xaa equals any amino acid
GRLRNGIXGAAGIPRANASRTNFSSHTNQSGGSELRQREGQRFGAAHVWENGARSNVTVRNTNQRLEPIRLRSTSNSRSRSPIQRQSGTVYHNSQRESRPVQQTTRRSVRRRGRTRVFLEQDRERERRGTAYTPFSNSRLVSRITVEEGEESSRSSTAVRRHPTITLDLQVRRIRPGENRDRDSIANRTRSRVGLAENTVTIESNSGGFRRTISRLERSGIRTYVSTITVPLRRISENELVEPSSVALRSILRQIMTGFGELSSLMEADSESELQRNGQHLPDMHSELSNLGTDNNRSQHREGSSQDRQAQGDSTEMHGENETTQPHTRNSDSRGGRQLRNPNNLVETGTLPILRLAHFFLLNESDDDDRIRGLTKEQIDNLSTRHYEHNSIDSELGKICSVSXAEFWXP

SEQ ID NO: 4729 - protein, 37 aa, Homo sapiens
MADATCTLLVIFCVMGYEMVHRKKPEKYAKVRFILRV

SEQ ID NO: 4730 - protein, 26 aa, Homo sapiens
MDLVEAFNHSRGPQVMLISLLAGVLV

SEQ ID NO: 4731 - protein, 35 aa, Homo sapiens
MWSRMVRSLWYIMFTWQGGSCVLSGTGSLLSYTRT

SEQ ID NO: 4732 - protein, 224 aa, Homo sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRCGSSPVPSTAAWIAAPPSCRGCGSTTTLACRRRTSQIWSLDLQQLMIN

SEQ ID NO: 4733 - protein, 11 aa, Homo sapiens
MWPWDMVFSWS

SEQ ID NO: 4734 - protein, 51 aa, Homo sapiens
  SITE (51): Xaa equals any amino acid
MTVVTALLLIILQTRNLNSGQISVKNWQMFFMRTLIMNLSAAFQKVRCKMX

SEQ ID NO: 4735 - protein, 40 aa, Homo sapiens [sequence omitted]

SEQ ID NO: 4736 - protein, 34 aa, Homo sapiens
MLSQCLLQFVVWVFFFLKPHNNFGKQCMGRTCVC

SEQ ID NO: 4737 - protein, 25 aa, Homo sapiens
MYFCDTVIMFCICLILADLQYAIKV

SEQ ID NO: 4738 - protein, 45 aa, Homo sapiens
MRWTCLLGTPGHPLFFLLCAWSIMSTPADPWKRKCLCCRVLHGHE

SEQ ID NO: 4739 - protein, 36 aa, Homo sapiens
MLYLNMNGKFWFLAFTFYYLNFINANISFVISYSIS

SEQ ID NO: 4740 - protein, 36 aa, Homo sapiens; identical to SEQ ID NO: 4739

SEQ ID NO: 4741 - protein, 36 aa, Homo sapiens; identical to SEQ ID NO: 4739

SEQ ID NO: 4742 - protein, 70 aa, Homo sapiens
MPWCPCWTVLTSKPFLSMLPACSAWPRSTFSSRTSVWKSLRSPRLSWRNTTRLQCFSPSNSCSGMSYFAS

SEQ ID NO: 4743 - protein, 45 aa, Homo sapiens
MGVFDPTEIHNRGQLKSHMKEAMIKLGFHLLCFFMYLYSGSNCPC

SEQ ID NO: 4744 - protein, 29 aa, Homo sapiens
MVLVLLCVGPLGTQAGANGIWAELTEFLE

SEQ ID NO: 4745 - protein, 58 aa, Homo sapiens
MLLLVSVFSPVLFSRSSTVEMDVEPFCLVLSSAFPEITPPISCLCLNMFFSLLRSPHS

SEQ ID NO: 4746 - protein, 33 aa, Homo sapiens
MVCACLLSLRLGLLTECEYKYPYLGEKYIFKGW

SEQ ID NO: 4747 - protein, 33 aa, Homo sapiens
MFCSLLFSQYVQWLLAQNRQYSLTECYWTLSVY

SEQ ID NO: 4748 - protein, 290 aa, Homo sapiens
MAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 4749 - protein, 24 aa, Homo sapiens
MGGTPSTKCLVTSAWSGFSACTPC

SEQ ID NO: 4750 - protein, 25 aa, Homo sapiens
MTRSLVLRFKVLLMLGLLIEVSEEL

SEQ ID NO: 4751 - protein, 73 aa, Homo sapiens
MPSLWDRFSSSSTFQLTLVLRLDSRLWPKIQGLFSSANSPFLPGFSQSLTLSTGFRVIKKKLYSSEQLLIEEC

SEQ ID NO: 4752 - protein, 55 aa, Homo sapiens
MPHPPLPETSLEAQLPMGLLQLLRCSVQAWSPPPSSFCPGSEPRSASAHWGYWWP

SEQ ID NO: 4753 - protein, 27 aa, Homo sapiens
MPISVSSFCAAVIVGLPVSFELWALPG

SEQ ID NO: 4754 - protein, 33 aa, Homo sapiens
MIVVVLWINLCSWFCFVSPLPKCSFQYYTRKRS

SEQ ID NO: 4755 - protein, 67 aa, Homo sapiens
  SITE (45): Xaa equals any amino acid
MVLMGIFFSTLFVFMDSGTWASSIFFHLMTCVLSLGVVLPWLHRXIRRIPCSGFFSFSSRQTPASTS

SEQ ID NO: 4756 - protein, 7 aa, Homo sapiens
VGILCLW

SEQ ID NO: 4757 - protein, 144 aa, Homo sapiens
MDVRKLDFPSASFDVVLEKGTLDALLAGERDPWTVSPEGVHTVDQVLSEVSRVLVPGGRFISMTSAAPHFRTRHYAQAYYGWSLRHATYGSGFHFHLYLMHKGGKLSVAQLALGAQILSPPRTPTSPCFLQDSDHEDFLSAIQL

SEQ ID NO: 4758 - protein, 18 aa, Homo sapiens
VLCSLSCMLKLGVCWRAS

SEQ ID NO: 4759 - protein, 96 aa, Homo sapiens [sequence omitted]

SEQ ID NO: 4760 - protein, 15 aa, Homo sapiens
MLHFCFIFYFSLLCF

SEQ ID NO: 4761 - protein, 24 aa, Homo sapiens
EKRRKKARSTGNLGCGTMSRRMRT

SEQ ID NO: 4762 - protein, 148 aa, Homo sapiens
  SITE (128): Xaa equals any amino acid
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVXEHWDPRIAKNYPQGRHNPSR

SEQ ID NO: 4763 - protein, 14 aa, Homo sapiens
MPEAHGPSEGLWGT

SEQ ID NO: 4764 - protein, 36 aa, Homo sapiens [sequence omitted]

SEQ ID NO: 4765 - protein, 25 aa, Homo sapiens
MGLHLTFLVILVDQMPLGHQSLLQD

SEQ ID NO: 4766 - protein, 377 aa, Homo sapiens [sequence omitted]

SEQ ID NO: 4767 - protein, 175 aa, Homo sapiens
MDLAGRKVLLFVSAAIMFAANLTLGLYIHFGPRPLSPNSTAGLESESWGDLAQPLAAPAGYLTLVPLLATMLFIMGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 4768 - protein, 31 aa, Homo sapiens
MWFMSNSAVLLWLWFKFLMFKVDAVFRRAFY

SEQ ID NO: 4769 - protein, 59 aa, Homo sapiens
  SITE (37): Xaa equals any amino acid
MWAKVPPPHKALGSPRSPHRQTWGSRPRVGPREEGLXVGRGITEWKEIEGAESAFAVMS

SEQ ID NO: 4770 - protein, 48 aa, Homo sapiens [sequence omitted]

SEQ ID NO: 4771 - protein, 11 aa, Homo sapiens
MRLLVLFCFIN

SEQ ID NO: 4772 - protein, 417 aa, Homo sapiens
NSRVDPRVRGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPLNGKEQGFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPISGMSEAGIPQSPDDSDSSYGSHSTDSLMGSSPVFNQRCKKRMRKI

SEQ ID NO: 4773 - protein, 38 aa, Homo sapiens
MLSGYPLSFFLLTICLVVLTARGTEGLCPGIWRPALFT

SEQ ID NO: 4774 - protein, 19 aa, Homo sapiens
MLLFLLLLLLSSLLALNDC

SEQ ID NO: 4775 - protein, 30 aa, Homo sapiens
MGAPTRKCSVQWLSLSVPFLSAQCSAWRSI

SEQ ID NO: 4776 - protein, 31 aa, Homo sapiens
MQSHFLKDFHPDPALDKHFLLFRSKTYKSCK

SEQ ID NO: 4777 - protein, 37 aa, Homo sapiens
MPFKYLFMGFISHILSAPSSETLHLFHLPSKESEADD

SEQ ID NO: 4778 - protein, 44 aa, Homo sapiens
MSGCGASGMNLFHVLCWELALGDHNPQSPQHQGKVPGAQEGKPT

SEQ ID NO: 4779 - protein, 33 aa, Homo sapiens
MATPSFLFFFLLLNFNSSFVWLFSFLCLFPVKL

SEQ ID NO: 4780 - protein, 44 aa, Homo sapiens
  SITE (8): Xaa equals any amino acid
  SITE (40): Xaa equals any amino acid
MCPLPMLXSLLTFSFFSLSYLLLLWSSSNSSSVHLNSTFXDPVG

SEQ ID NO: 4781 - protein, 25 aa, Homo sapiens
HLLIYRIFICTCFHLFVVNFLRQTH

SEQ ID NO: 4782 - protein, 38 aa, Homo sapiens
METSYITLLCVFTHVGFAVLALTAHGSAGHTPTHTNCH

SEQ ID NO: 4783 - protein, 39 aa, Homo sapiens
MWIMGLLYILVFYNFKISINSQKWERKRQQDFGSWRQIY

SEQ ID NO: 4784 - protein, 32 aa, Homo sapiens
MGAGCVAVLLLGQAAGETVFPWPCPVGPSMMS

SEQ ID NO: 4785 - protein, 25 aa, Homo sapiens
MLFFLCFCFLQLFHVYKANPFCSAH

SEQ ID NO: 4786 - protein, 45 aa, Homo sapiens
MDSILIFKWQKLGWGAFKTCFLNCVLTYTIWCFICLFFLTMSRRP

SEQ ID NO: 4787 - protein, 42 aa, Homo sapiens
MQKFVVIMYLCLVTIMFYRPTLVPGHYCKMLKSQENFTELKK

SEQ ID NO: 4788 - protein, 29 aa, Homo sapiens
MVIHYFLLFLVKSWCVMESTCSMCVCLCV

SEQ ID NO: 4789 - protein, 40 aa, Homo sapiens
MLAVFLRIKLRLAGTVKPKFLFVSFLAPLIFLDFEKFTVW

SEQ ID NO: 4790 - protein, 102 aa, Homo sapiens
MGLRNILKVCCTHDITTISIPLLLVHDMSEEMTIPWCLRRAELVFKCVKGFMMEMASWDGGISRTVQFLVPQSISEEMFYQLSNMLPQIFRVSSTLTLTSKH

SEQ ID NO: 4791 - protein, 102 aa, Homo sapiens; identical to SEQ ID NO: 4790

SEQ ID NO: 4792 - protein, 14 aa, Homo sapiens
MVPSEACPLVCTLV

SEQ ID NO: 4793 - protein, 57 aa, Homo sapiens
MWRRDQSLLLVSLQLPFSPVSGTPRFMPAVQPCQPHRLNTPSNSCSVFLGGGAPRGN

SEQ ID NO: 4794 - protein, 122 aa, Homo sapiens
VAEYREWGRARAGGRDQGLDPLSSFSLGRTGQLPPTLTPLLPVNGAVREESIHCKSVEEISTLVQKLADQSGLDVIRIRKPFHTDNPSIQGQWHPFTNKPTTFRGLRPREVQDPAPAQVQAQ

SEQ ID NO: 4795 - protein, 65 aa, Homo sapiens
MLSLLSLCLLNPQAPVLPDSGTCTLPLQSGVLRALRTMKHAWCIFLSVNFPHWLLFNPLHFYSKS

SEQ ID NO: 4796 - protein, 40 aa, Homo sapiens
MGTDALSFLLWGFPFLWSPCSPCPPSGAAGLKGGTRGGRV

SEQ ID NO: 4797 - protein, 55 aa, Homo sapiens
MPVTWFLAWSAFFQVCLGPSPARGYSTLQARYAFFQPLGCGHCIQVGTSFPSLPF

SEQ ID NO: 4798 - protein, 30 aa, Homo sapiens
MAMWVVAVIASSATLGLAKITHDLQSTLQL

SEQ ID NO: 4799 - protein, 38 aa, Homo sapiens
MLFFPHSPLNIVLYALLNTFSFVSQASLWMTPKYNFFH

SEQ ID NO: 4800 - protein, 46 aa, Homo sapiens
ADGPCFGPALFLTLALTWEGLEGPSHHPRSPSAVPFPCRLAAASPA

SEQ ID NO: 4801 - protein, 31 aa, Homo sapiens
MCVCVCVCVCVCVHRVLPCVVFFWRLSLWSR

SEQ ID NO: 4802 - protein, 32 aa, Homo sapiens
MRLSTWLTFNMCIFTLCIFLTGLSRLDCIHHI

SEQ ID NO: 4803 - protein, 17 aa, Homo sapiens
ASQTFSTELWCFGLWHT

SEQ ID NO: 4804 - protein, 33 aa, Homo sapiens
MKDRKQWAFKTRWPFFHFLMLSLALDCYRFLTS

SEQ ID NO: 4805 - protein, 30 aa, Homo sapiens
MAILLTFLVYVIITSIGKQLHKKNLYIFNF

SEQ ID NO: 4806 - protein, 15 aa, Homo sapiens
MRFLWCQPVASVWGS

SEQ ID NO: 4807 - protein, 294 aa, Homo sapiens
MMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 4808 - protein, 40 aa, Homo sapiens
MFVPYLWVFRSLSLSLFLFLSVFSISHLHLGSILCSLSQD

SEQ ID NO: 4809 - protein, 32 aa, Homo sapiens
MSIKRQSVLATLSLQIVAFPLQQGPRGDTGNL

SEQ ID NO: 4810 - protein, 31 aa, Homo sapiens
MQMLRKLFTAIRALFLAVCVLKVIVSLVPWE

SEQ ID NO: 4811 - protein, 37 aa, Homo sapiens
MLTHISFASFIRLVLTLGGDIYSQMRSRHKVKNGTIY

SEQ ID NO: 4812 - protein, 33 aa, Homo sapiens
MTSAFLFLFLDSVLFTWACVWLGDRQECQKAGR

SEQ ID NO: 4813 - protein, 26 aa, Homo sapiens
VNYLFKILTVHYVPTMKPLSPKTQTD

SEQ ID NO: 4814 - protein, 21 aa, Homo sapiens
MIRTPNQIQKPVLLYLLHWPS

SEQ ID NO: 4815 - protein, 55 aa, Homo sapiens
MDLLFLDMGLSAWQMWKLKFLVPLQVLASQPCRKVVYRPFILKLITCPWWTFLWW

SEQ ID NO: 4816 - protein, 12 aa, Homo sapiens
DSTLLIFLIITL

SEQ ID NO: 4817 - protein, 25 aa, Homo sapiens
  SITE (7): Xaa equals any amino acid
LNTSDFXFVYCFSLSFSSLSKQLLD

SEQ ID NO: 4818 - protein, 37 aa, Homo sapiens
MNKQKRKQGTCVSLSLLFCLSLCPLSYVSHAVSCPCF

SEQ ID NO: 4819 - protein, 23 aa, Homo sapiens
MLLCILIVCIYSAYVACLQNYIK

SEQ ID NO: 4820 - protein, 18 aa, Homo sapiens
MPFRWAASLATWFQGAVL

SEQ ID NO: 4821 - protein, 383 aa, Homo sapiens
LLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 4822 - protein, 44 aa, Homo sapiens
KALYTWLPSVLPLALSMRSQALGRLCNHPPNLVHFPQVAFLNSP

SEQ ID NO: 4823 - protein, 37 aa, Homo sapiens
KTITHVLQLLVLLPAHSWYLSIIVVASEKNSKKKEYT

SEQ ID NO: 4824 - protein, 29 aa, Homo sapiens
MSTFYIFIFMNNTVRKGSNASCNYWYIKV

SEQ ID NO: 4825 - protein, 123 aa, Homo sapiens
YWALLRTLLALAAFSTAIAALKLWNEDFRYGYSYYNSACRISSSSDWNTPAPTQSPEEVRRLHLCTSFMDMLKALFRTLQAMLLGVWILLLLASLAPLWLYCWRMFPTKGKRDQKEMLEVSGI

SEQ ID NO: 4826 - protein, 40 aa, Homo sapiens
MCSHPLASRALFPGILVKVVSCIPLPFYLGFDIGKVYLKT

SEQ ID NO: 4827 - protein, 74 aa, Homo sapiens [sequence omitted]

SEQ ID NO: 4828 - protein, 43 aa, Homo sapiens
  SITE (41): Xaa equals any amino acid
MSHHAWLSVLFSVSVPSVSSAYMFSILSCSFSSVPTRYFWXKN

SEQ ID NO: 4829 - protein, 67 aa, Homo sapiens
MTKVPSCFLLPVLLLGRKRGLMRLHSGAHITRCICRHRAGCLQPGEGQREGVYECECVCMEVGALGV

SEQ ID NO: 4830 - protein, 67 aa, Homo sapiens; identical to SEQ ID NO: 4829

SEQ ID NO: 4831 - protein, 129 aa, Homo sapiens [sequence omitted]

SEQ ID NO: 4832 - protein, 36 aa, Homo sapiens
MHNTFFNTILITKHLIYCYFVCFLNCIFCQCGISCL

SEQ ID NO: 4833 - protein, 31 aa, Homo sapiens
MKSQSSLSVGILRVTLCLVPSCVPAIDCNAQ

SEQ ID NO: 4834 - protein, 46 aa, Homo sapiens
MLVLSEQWELVWDLLLQLPWWLKIEALGNGSSVWKETVHLGFLAWR

SEQ ID NO: 4835 - protein, 55 aa, Homo sapiens
MRQQRWPRSILLLCGELCFSLVTIGKGSCSYVSLPVPQSFVHGVGHHLLPIQGND

SEQ ID NO: 4836 - protein, 51 aa, Homo sapiens
MPRAWWPSYTCSLLCLSISVHQFDSQTMFPSKWLWSRNEKESSSLGKSKRK

SEQ ID NO: 4837 - protein, 51 aa, Homo sapiens
MNPFIFNVITDTVQFKSSILLLTFASIFLSSFPAFSYFNQIVLTISLHHVF

SEQ ID NO: 4838 - protein, 44 aa, Homo sapiens
MRQNFVAQFVQLLKCWLCDVWSGVVVEKNWAPSVDQCQLQVLQF

SEQ ID NO: 4839 - protein, 45 aa, Homo sapiens [sequence omitted]

SEQ ID NO: 4840 - protein, 40 aa, Homo sapiens
MCLHLLLAISGILNLHCHLVLCSCGRYTQKTQANTTWVTS

SEQ ID NO: 4841 - protein, 40 aa, Homo sapiens; identical to SEQ ID NO: 4840

SEQ ID NO: 4842 - protein, 343 aa, Homo sapiens
  SITE (184): Xaa equals any amino acid
  SITE (198): Xaa equals any amino acid
  SITE (210): Xaa equals any amino acid
  SITE (300): Xaa equals any amino acid
  SITE (307): Xaa equals any amino acid
MYISPEEFKPIAEKLTGSTPAASYEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPXDFPFWFSPAQFTGXIILSKDATHVRXFRLFVPNHRSLNVDMEWLYGASESSNMEVDIGYIPQMELEATGPSVPSVILDEDGSMIDSHLPSGEPLQFVFEEIKWAAGAELGGGCPAXGGGHVPXQEVSYLPFTEAFDRAKAENKLVHSILLWGALDDQSC

SEQ ID NO: 4843 - protein, 55 aa, Homo sapiens
MTFGEYVALIFFTLIIFLSSRQPIAPWRPHQPCKFSPAAWRLGRGAAVTRRYTRL

SEQ ID NO: 4844 - protein, 52 aa, Homo sapiens
MTLHVSRLWCCCPKKGQAWSAYGALLWCYLAPVSLESEEVWPLKIKLPPELL

SEQ ID NO: 4845 - protein, 51 aa, Homo sapiens
MYFPCRWLLPSVLGYLAMELLRQSLPRWRSSQCLHLPIRNTRCLPWCKVPR

SEQ ID NO: 4846 - protein, 16 aa, Homo sapiens
MLLGNLIATMQATGNL

SEQ ID NO: 4847 - protein, 48 aa, Homo sapiens
MFWEVLFIVCFPTFALITRLSSLIIETMSLYLVPSIVPSTQCMHSLLV

SEQ ID NO: 4848 - protein, 10 aa, Homo sapiens
MRLFVLLLMT

SEQ ID NO: 4849 - protein, 1 aa, Homo sapiens
I

SEQ ID NO: 4850 - protein, 32 aa, Homo sapiens
MGGIQYCMWGHPGWGGDAWHPSLHSPARPGGV

SEQ ID NO: 4851 - protein, 21 aa, Homo sapiens
MVIIEMLLKILWVVFWAGYPC

SEQ ID NO: 4852 - protein, 7 aa, Homo sapiens
DVHMRSR

SEQ ID NO: 4853 - protein, 38 aa, Homo sapiens
  SITE (14): Xaa equals any amino acid
MRSPLSASALLLWXSSVARAFSSPSLLMAVPSPTCSRY

SEQ ID NO: 4854 - protein, 38 aa, Homo sapiens
  SITE (14): Xaa equals any amino acid
  SITE (34): Xaa equals any amino acid
MRSPLSASALLLWXSSVARAFSSPSLLMAVPSPXCSRY

SEQ ID NO: 4855 - protein, 38 aa, Homo sapiens; identical to SEQ ID NO: 4854
  SITE (14): Xaa equals any amino acid
  SITE (34): Xaa equals any amino acid

SEQ ID NO: 4856 - protein, 38 aa, Homo sapiens; identical to SEQ ID NO: 4854
  SITE (14): Xaa equals any amino acid
  SITE (34): Xaa equals any amino acid

SEQ ID NO: 4857 - protein, 41 aa, Homo sapiens
ISSLVGNLATIQKFKIYCQPSRFWNTSPSIRTGWRPVDTPK

SEQ ID NO: 4858 - protein, 15 aa, Homo sapiens
MTAWYIWVTCVGSLL

SEQ ID NO: 4859 - protein, 60 aa, Homo sapiens [sequence omitted]

SEQ ID NO: 4860 - protein, 61 aa, Homo sapiens [sequence omitted]

SEQ ID NO: 4861 - protein, 17 aa, Homo sapiens
MGFVVLLLCQVPLGQLG

SEQ ID NO: 4862 - protein, 146 aa, Homo sapiens
MVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQVQEPLP

SEQ ID NO: 4863 - protein, 54 aa, Homo sapiens
MLAFICSISSLLGCFWGITCLSSKLETSNSPGDAVALFVGQWHLLVVCNVYSLV

SEQ ID NO: 4864 - protein, 26 aa, Homo sapiens
MYQYYIPLHCLIIIIIIVHCMGIPRL

SEQ ID NO: 4865 - protein, 31 aa, Homo sapiens
MARAATGAGKATWTLFCWLMAPRACVHKTSS

SEQ ID NO: 4866 - protein, 23 aa, Homo sapiens
MGLFLLFLLRVGVGCVICKYFCA

SEQ ID NO: 4867 - protein, 62 aa, Homo sapiens
LECWKDMIRAACSSQKSVSTIKWMPNHQTHKCSRCVPGYGISRYKKYFNYSFVINITYEKKI

SEQ ID NO: 4868 - protein, 26 aa, Homo sapiens
MYILFLSSVLIMGAFLKLISYFPIYI

SEQ ID NO: 4869 - protein, 37 aa, Homo sapiens
MLLAYHIFISVSICRLLGPGNDSGEFPSLVSGIYSHL

SEQ ID NO: 4870 - protein, 43 aa, Homo sapiens
MSTLFTWLMVLRYLLPNSCFVLNRPSFCNPFGTSPISCRKASS

SEQ ID NO: 4871 - protein, 70 aa, Homo sapiens
MPNGHWHWACLCHWGSTQAVSICATLAFPSRSSRRWASTTTRPLAASLLSHCTLLRGFLRRQDSAVPCCS

SEQ ID NO: 4872 - protein, 33 aa, Homo sapiens
MTSITSHVLVTVLLIISLSTQTLETVSLTRSRE

SEQ ID NO: 4873 - protein, 23 aa, Homo sapiens
MACILFLNAFLLIPILLGIWTFY

SEQ ID NO: 4874 - protein, 58 aa, Homo sapiens
MKSFQIPLFFFPNGFHMCLKYLYFELSDFPCPPFSFVPSLSQHQSRIQNLPVKGQPSF

SEQ ID NO: 4875 - protein, 28 aa, Homo sapiens
MLVGAALPLVPGVASAQSQRAGSRVLHR

SEQ ID NO: 4876 - protein, 32 aa, Homo sapiens
MSNAELALLLFIILTVGHYAVVWSIYLGKTTG

SEQ ID NO: 4877 - protein, 46 aa, Homo sapiens
MVSGLIKHSNWLCFTLALVHAKCSISFSLLHCSFAMLLCSGLDVIF

SEQ ID NO: 4878 - protein, 24 aa, Homo sapiens
MWFLSLLLSFICFLISAEYEICLF

SEQ ID NO: 4879 - protein, 32 aa, Homo sapiens
MAAPGWPGPRSASVVALTFDKSFPCLCLGCPI

SEQ ID NO: 4880 - protein, 55 aa, Homo sapiens
GLPFCLVLACILPCYHLLLFLPRWFVKNKSPGCMCPLIHSVWAKENEALMVTWCF

SEQ ID NO: 4881 - protein, 9 aa, Homo sapiens
MYCLSAILI

SEQ ID NO: 4882 - protein, 50 aa, Homo sapiens
MALSHLLLHSRPLLEVCLSHVLLSPHERPLLLFPCLLSGLSGAVLRVLLG

SEQ ID NO: 4883 - protein, 34 aa, Homo sapiens
FCTVCLLTFIEHILPSSIRITHLMVRKSCWEYDS

SEQ ID NO: 4884 - protein, 57 aa, Homo sapiens
MAAIWHFAFCTYLDVLDISPRPLIDNCPGVFLAAEMMWTEFIWPIPRQWPLRLFPKF

SEQ ID NO: 4885 - protein, 72 aa, Homo sapiens
MRAGTFDWFAVACQELYLLRAQMTESVQPSVIHLFSLFLFPYRVCEPLLTKYQSGPSPAHVKEEGAVGLRPH

SEQ ID NO: 4886 - protein, 15 aa, Homo sapiens
MTTVSPIPISCLFAA

SEQ ID NO: 4887 - protein, 23 aa, Homo sapiens
MLVGVVDVSCLLWPSLPLLPENT

SEQ ID NO: 4888 - protein, 59 aa, Homo sapiens
TLAQEHRSRGLAWSTRPPLCKAPEGPRGCGLIRRLHLWTGLHTRSYRTAICLPCRGRWP

SEQ ID NO: 4889 - protein, 86 aa, Homo sapiens
MQSREPPPVCFMAMVLSACVFSFFLNRLFSGSLISLSASRSLFCLGCFSPAVPSTRFPGSCPPRALPQGSTTPRCSPTALSGRPPV

SEQ ID NO: 4890 - protein, 19 aa, Homo sapiens
MLHCFKKKKMLMIVLGLQA

SEQ ID NO: 4891 - protein, 33 aa, Homo sapiens
MMLALFIVLLLIPPRQNENQMPFPEGLSEGFGP

SEQ ID NO: 4892 - protein, 48 aa, Homo sapiens
MGLQVTPPLSFTGLWFVVMANMGWQRTILTKVEALQHGVQPLSMDSGP

SEQ ID NO: 4893 - protein, 20 aa, Homo sapiens
MGCPGLEGTLFLPPPLPNLS

SEQ ID NO: 4894 - protein, 98 aa, Homo sapiens
MNTKGRDFHLAVFVFPQPSMVRGSRNGCLITAVTPSRKDSQRNCSLKKKKIHKVGCTLKVLRRASVLENLPEILKAYKKGESSKLNFDSHGWGLYLFL

SEQ ID NO: 4895 - protein, 21 aa, Homo sapiens
METSGLVWLLLLEKLGAKAAS

SEQ ID NO: 4896 - protein, 10 aa, Homo sapiens
MGGVSGFSVA

SEQ ID NO: 4897 - protein, 38 aa, Homo sapiens
  SITE (35): Xaa equals any amino acid
  SITE (38): Xaa equals any amino acid
MALQWFCILVGNLFWFILAFPQPSCWFFGKMWHPXQTX

SEQ ID NO: 4898 - protein, 59 aa, Homo sapiens
  SITE (26): Xaa equals any amino acid
MALYAGFLLWAGHLQEGYSWRNGWGXVAVDSSLGPERIESELGKLQSELKSRNPVGGKY

SEQ ID NO: 4899 - protein, 141 aa, Homo sapiens
HSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 4900 - protein, 68 aa, Homo sapiens
MWRGVARGRKRKCLVLFCSPALLSQQLFVIVVVVLRQVPPGACGILLPVSVSKCHRPPIATYSWHCTF

SEQ ID NO: 4901 - protein, 16 aa, Homo sapiens
MFQSVSLTYLHFKYGL

SEQ ID NO: 4902 - protein, 29 aa, Homo sapiens
MAVRFEALQSCGTPWCVCSVLGTCMGTHR

SEQ ID NO: 4903 - protein, 32 aa, Homo sapiens
MLHLSSFLVYFANWLLNSETWSDSGSVSLAIL

SEQ ID NO: 4904 - protein, 15 aa, Homo sapiens
MFSIIAFPLILLTCC

SEQ ID NO: 4905 - protein, 72 aa, Homo sapiens
MISSGSSRYAETWDLLLFLRLTCCAHCAWTPWHDAGRGCRTHTSFEVRQSTNPSSTTHSFSSSQLCGLGQIA

SEQ ID NO: 4906 - protein, 37 aa, Homo sapiens
LLLVLLIFVASAHGALVSPQSNGGSPKQLHYRVILGK

SEQ ID NO: 4907 - protein, 25 aa, Homo sapiens
MFEIRTALSLRLIPLFVSTCGVTQK

SEQ ID NO: 4908 - protein, 30 aa, Homo sapiens
MLVAFLVLYFSFPYLAFVGPKPTNNRLLKE

SEQ ID NO: 4909 - protein, 66 aa, Homo sapiens [sequence omitted]

SEQ ID NO: 4910 - protein, 70 aa, Homo sapiens
MLGFLTFRSLTWIRLGAAQWSRWVPVSLVIRRGLGVGRAPESQQCAWAPTPSSTCHTSEGSYSCTQAVES

SEQ ID NO: 4911 - protein, 30 aa, Homo sapiens
MYIKSPCCACLIYVIFICQLCLTKACGWGE

SEQ ID NO: 4912 - protein, 20 aa, Homo sapiens
MLLLYFFQHIQPSPWGAFHI

SEQ ID NO: 4913 - protein, 18 aa, Homo sapiens
MFPSWPFLWLTLCSLCIC

SEQ ID NO: 4914 - protein, 42 aa, Homo sapiens
MEKCEKLNCLEMSRFFYLQLLLACPTVVFEYFLYSTPKDFNF

SEQ ID NO: 4915 - protein, 50 aa, Homo sapiens
MFYFMNLTKFFFLDLANFNRVFSYQTFTYLLKLHSCKLFGGICFYFYFVV

SEQ ID NO: 4916 - protein, 37 aa, Homo sapiens
LNDGLCWFFCLFGWFVCLFWHSVKGSQTFTYYLLSCP

SEQ ID NO: 4917 - protein, 37 aa, Homo sapiens; identical to SEQ ID NO: 4916

SEQ ID NO: 4918 - protein, 38 aa, Homo sapiens; identical to SEQ ID NO: 4680

SEQ ID NO: 4919 - protein, 34 aa, Homo sapiens
HLFYLGFIHLLECVGLHLLPKLGSFKAFFLQIYF

SEQ ID NO: 4920 - protein, 140 aa, Homo sapiens
SQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 4921 - protein, 11 aa, Homo sapiens
MQESPSQLLSS

SEQ ID NO: 4922 - protein, 33 aa, Homo sapiens
MQSVSFLVVSFLGQCFFVFFLEMFVLPPPVDPG

SEQ ID NO: 4923 - protein, 79 aa, Homo sapiens
MPLRRSGGFEYLSLPPIQEIQSLVSLSLSVSFFLFLPPNPSHSLPPSLLPLFAIIFSLCFFSLLPSLWAVMKINSDCVH

SEQ ID NO: 4924 - protein, 31 aa, Homo sapiens
MSGEDPLLSIPTCATPGSPCWGLLGPFSSCL

SEQ ID NO: 4925 - protein, 1 aa, Homo sapiens
I

SEQ ID NO: 4926 - protein, 23 aa, Homo sapiens
MSDPKENVFTLMLRCSAAPLCSV

SEQ ID NO: 4927 - protein, 35 aa, Homo sapiens
MFPNIMFCTLMLISLCVVPDTSWDLKKCCFFLKDG

SEQ ID NO: 4928 - protein, 9 aa, Homo sapiens
MVGSVDFSF

SEQ ID NO: 4929 - protein, 22 aa, Homo sapiens
MLLLGLEGLLFMLFNALSNVFF

SEQ ID NO: 4930 - protein, 3 aa, Homo sapiens
LLI

SEQ ID NO: 4931 - protein, 37 aa, Homo sapiens
MGIGALILLFFLTVVLPFYGFNQPPPPGKHLLWACWV

SEQ ID NO: 4932 - protein, 43 aa, Homo sapiens
MAVHHPAFQLNVTCLLLLKMAFCVLQRLAWEVLCSIAVNLDTF

SEQ ID NO: 4933 - protein, 52 aa, Homo sapiens
LPLEDLCKGGLGTKENVLFGRAGSKGTGQGLVGLGNGSLSWIPLMKRLGLFT

SEQ ID NO: 4934 - protein, 39 aa, Homo sapiens
MAARPLPVSPARALLARPGRCSARALRGPRGELMEPRKS

SEQ ID NO: 4935 - protein, 72 aa, Homo sapiens
MMPVCRVGLWNGSCLCVCVCIFMGMGACLVCICTCLYCCVPVNTCLCMDGRSQAQAWPLPRACGHTSCSSPK

SEQ ID NO: 4936 - protein, 11 aa, Homo sapiens
MHFHADYMHGC

SEQ ID NO: 4937 - protein, 31 aa, Homo sapiens
MGSYKGSTKKVKFILMTLKIYMFVLNVGRCQ

SEQ ID NO: 4938 - protein, 6 aa, Homo sapiens
MCSLPL

SEQ ID NO: 4939 - protein, 32 aa, Homo sapiens
MFLISIEIALLPHISLAYPWSLAILDKDMLFK

SEQ ID NO: 4940 - protein, 33 aa, Homo sapiens
MFLIIFISLNFSLCHSNLTFTHQQITMQKKKYF

SEQ ID NO: 4941 - protein, 53 aa, Homo sapiens
  SITE (8): Xaa equals any amino acid
MSHCLFLXFCLKIPSWKSCHAIGDCDILLVMYTATGFVCYVDGLYLCYSEGIK

SEQ ID NO: 4942 - protein, 97 aa, Homo sapiens
MAQPPQNLKRFSSCRAFARLGYPPYFPCLPSSAARPSVPASAQPSVKGSPASNLHCTASPKTVTSWKAGAQLPLNKRVAKKEKKKKKKKKKKKKKGR

SEQ ID NO: 4943 - protein, 22 aa, Homo sapiens
MTFFVFMEVRTPVMQTGSRSLL

SEQ ID NO: 4944 - protein, 7 aa, Homo sapiens
MKCILEF

SEQ ID NO: 4945 - protein, 30 aa, Homo sapiens
MYLFNNFFFSSWYLILVLLNQYSGTIVGVY

SEQ ID NO: 4946 - protein, 29 aa, Homo sapiens
MGARHCIWPFCRYFFPLSLIVPIDFSPFL

SEQ ID NO: 4947 - protein, 38 aa, Homo sapiens
MKETGLIAIILLLAAFSKSLFLKPPPILFKQIKTKISC

SEQ ID NO: 4948 - protein, 6 aa, Homo sapiens
IYSALD

SEQ ID NO: 4949 - protein, 34 aa, Homo sapiens
MRSFCFLGKVFHFLVWLFAHPRRRKTSLRVTFTW

SEQ ID NO: 4950 - protein, 34 aa, Homo sapiens
MRLCVFLALLHVPFQLMAHSDSQRFMPKLHTIVF

SEQ ID NO: 4951 - protein, 33 aa, Homo sapiens
MRLGAKTSLFFFSFLFLLVFAKLLLLKKGSYCY

SEQ ID NO: 4952 - protein, 71 aa, Homo sapiens [sequence omitted]

SEQ ID NO: 4953 - protein, 20 aa, Homo sapiens
MKLLALVISILICTGQIYNC

SEQ ID NO: 4954 - protein, 35 aa, Homo sapiens
MEAAKSLCPRAPLSCSALLLCSFCIVGEDGYHCVC

SEQ ID NO: 4955 - protein, 33 aa, Homo sapiens
MSEFLLLCIFPSIWYCQFKHKCWERYRATGTLT

SEQ ID NO: 4956 - protein, 49 aa, Homo sapiens
  SITE (8): Xaa equals any amino acid
  SITE (15): Xaa equals any amino acid
  SITE (16): Xaa equals any amino acid
YFTVIYFXFQLSIFXXSLSMGTYLPHFFRSDMTHKKDGFGFLKTLTISN

SEQ ID NO: 4957 - protein, 30 aa, Homo sapiens
MIFLFLFFVFCFLVSQYVSPFYSNTFFGVQ

SEQ ID NO: 4958 - protein, 29 aa, Homo sapiens
MCLPSDVTFPLLLLGMCLVPLSPAHVTVT

SEQ ID NO: 4959 - protein, 12 aa, Homo sapiens
MIVIVFYLINLL

SEQ ID NO: 4960 - protein, 81 aa, Homo sapiens
WGKILVVLMVNLSYWILCMPHSRIHCLSLIMDGMQQHPSILHSLQGKNCAWGLKCSMCSSISLSSVMQNGIFNGRSALLRC

SEQ ID NO: 4961 - protein, 520 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTMLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 4962 - protein, 37 aa, Homo sapiens
MGLPVSWAPPALWVLGCCALLLSLWALCTACRRPRTL

SEQ ID NO: 4963 - protein, 35 aa, Homo sapiens
MNVSIFLVGLFLIIELYIAGSLTTSLEFQQEAFAR

SEQ ID NO: 4964 - protein, 47 aa, Homo sapiens
MLFLCNNWLVSLFCSLLIGSCFLCVQNKNKFGQKKKKKKKKKKKKKK

SEQ ID NO: 4965 - protein, 46 aa, Homo sapiens
MPEPLLGLSVVFTLVLGHPSFGRGGKAAGKMETVGGVCLPIGLALV

SEQ ID NO: 4966 - protein, 19 aa, Homo sapiens
MAWVGLASLGVCCPISRVP

SEQ ID NO: 4967 - protein, 34 aa, Homo sapiens
MCILVLVLSVIILILGLIIWLVYKTNDCLRSFSR

SEQ ID NO: 4968 - protein, 67 aa, Homo sapiens
PFLGWNQGAWVGVAAGNMPPCLALCRNPWKIRPSSLPLSASCTRARSRMSALPQPAPSGVFASSDGR

SEQ ID NO: 4969 - protein, 257 aa, Homo sapiens
MDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKFISGFQS

SEQ ID NO: 4970 - protein, 291 aa, Homo sapiens
MDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCMLPLNKEERRKNKELKILSMILPLIYLCLNPTVSQNQNSFYLRPGFLSVLFF

SEQ ID NO: 4971 - protein, 23 aa, Homo sapiens
MYIIAFNPLLTPPSTASPTAIGA

SEQ ID NO: 4972 - protein, 64 aa, Homo sapiens
  SITE (38): Xaa equals any amino acid
MWLLRQPCLAGFLLQVLEGRVPQSQAEADSGGLGAGGXTPAGGRRGLCQQSEQPRGPIPHILQV

SEQ ID NO: 4973 - protein, 64 aa, Homo sapiens
MNGFLPLWGWTLGLSWWERRRGLPPLSELPPTGGQESTLQPRALWGVHAWGLWVGTMDRPWSLS

SEQ ID NO: 4974 - protein, 23 aa, Homo sapiens
MLFLKVCLCLFKSYSMASWEALR

SEQ ID NO: 4975 - protein, 82 aa, Homo sapiens
MGLLLWGCFCTRGLPRCAPCLPPTWLSLLLGRTRPHVLRMLQKCGPWRDPKDTWHRPGRGRPRLVSAPFHGQTGLLSCTINL

SEQ ID NO: 4976 - protein, 31 aa, Homo sapiens
MESILMILILSVPTWRMHLLLLEVSAVAGLL

SEQ ID NO: 4977 - protein, 11 aa, Homo sapiens
QTALRRPHGPR

SEQ ID NO: 4978 - protein, 49 aa, Homo sapiens
RMLLLFIYLLVDGHLGWFHIFAIANCAAINMHVQVSFSNNDFFLLTPCS

SEQ ID NO: 4979 - protein, 26 aa, Homo sapiens
MFTLSLLFKLFRISFSLPFRRSVFTL

SEQ ID NO: 4980 - protein, 86 aa, Homo sapiens
MLSYSSAMFSQKKLITSSLLWLLQLQEVPAMSHVVFDQWSPVPGQRRQLYNVICVVKILPLTQNGTVQSLSVYMEKSHAPGLTQKK

SEQ ID NO: 4981 - protein, 58 aa, Homo sapiens [sequence omitted]

SEQ ID NO: 4982 - protein, 74 aa, Homo sapiens
MTVSLVSRSSVFNTCIYNAQARRPCHQPNVITAGRWKMSLKQSLCALFVLSLIQSNLKPQTDLPPVLFSGGFSP

SEQ ID NO: 4983 - protein, 82 aa, Homo sapiens
  SITE (71): Xaa equals any amino acid
MKWRCLMCFTLACLTVFYLTVNSAVFYCERKPQCLSSLRNWGERWTTTVVHFLSVLGECHTFPSQSKRNLXEILRETVSPQV

SEQ ID NO: 4984 - protein, 44 aa, Homo sapiens
KFMLCVSMVCFILLLSILLYEYTKICVSVHRLIDIWVITTLKLL

SEQ ID NO: 4985 - protein, 32 aa, Homo sapiens
MVRILSMVVIIIIIINGSPLCVLSYFIFTIFT

SEQ ID NO: 4986 - protein, 28 aa, Homo sapiens
MMGIWGIERSWVGNIAWVISLLTLYCKV

SEQ ID NO: 4987 - protein, 137 aa, Homo sapiens
ITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 4988 - protein, 42 aa, Homo sapiens
LFLFFLSPSDFSAYHLHFSPLTHSELIESCFCHHHTTETGHR

SEQ ID NO: 4989 - protein, 38 aa, Homo sapiens
MVIFCSLLSLIAYSIMAFLKKNLCIFSHPYLFAYFSNH

SEQ ID NO: 4990 - protein, 32 aa, Homo sapiens
MYYISTFLILTWAYALSLIVINLCCSSICNTL

SEQ ID NO: 4991 - protein, 42 aa, Homo sapiens
MNSNRLELLLYITQLALCTCRFCILGFNCGSKIFGGKKAIQQ

SEQ ID NO: 4992 - protein, 36 aa, Homo sapiens
MGSIAGTQGCRPRRLFFLFSLCRLISSLSVIWFPCP

SEQ ID NO: 4993 - protein, 50 aa, Homo sapiens
MWNIFSYVCWLLVCLLLRSVCSCLLPSFKWDLFFACSLVHTFFFFIDSGC

SEQ ID NO: 4994 - protein, 20 aa, Homo sapiens
SGEGAWVPGASLALHQDPVE

SEQ ID NO: 4995 - protein, 11 aa, Homo sapiens
MVLFLLRFLFL

SEQ ID NO: 4996 - protein, 15 aa, Homo sapiens
METHRQQLRKMVCQQ

SEQ ID NO: 4997 - protein, 36 aa, Homo sapiens
MLSDWLIIVLQCYVQVTLILLIVVPRCKSSDADILL

SEQ ID NO: 4998 - protein, 26 aa, Homo sapiens
MTSRWCHLKEPRFLFSVCGFILLVLL

SEQ ID NO: 4999 - protein, 38 aa, Homo sapiens
MISCLNILRVLYLLWGLLALSALTQIIGYITWLMFLYT

SEQ ID NO: 5000 - protein, 58 aa, Homo sapiens
MLRQEICLIRTGSSVLSVTLVALLLQVITLVMYMTLRSKRGLLTMTWRYQKSKRLPCK

SEQ ID NO: 5001 - protein, 52 aa, Homo sapiens
TQSLDPDETSPPPHLCPHQDKELLPVFPLGHGASCPPSSPARDPKAGTTPPA

SEQ ID NO: 5002 - protein, 23 aa, Homo sapiens
MLLLQSLFFSHELGVGWGREREG

SEQ ID NO: 5003 - protein, 21 aa, Homo sapiens
MPCFSLLSLPLWDPLVILVFC

SEQ ID NO: 5004 - protein, 44 aa, Homo sapiens
MPRTSTFQQWLSSPTFWWLVLRWGPRIGSPQTSWGCKRAQPWPG

SEQ ID NO: 5005 - protein, 15 aa, Homo sapiens
MLLRVFLVVVTQCGC

SEQ ID NO: 5006 - protein, 33 aa, Homo sapiens
MSDRWSPFIPFLLLAPVSSGSGHLTFSCPAGSA

SEQ ID NO: 5007 - protein, 52 aa, Homo sapiens
MAMAMARITPPTMGMVWPLHTLGKCLALTQMQTLVPRVAPVPIPFYPELTSA

SEQ ID NO: 5008 - protein, 39 aa, Homo sapiens [sequence omitted]

SEQ ID NO: 5009 - protein, 36 aa, Homo sapiens
MLLLYLSSFTFLESPTTGQRLKGTDLLCRMAWPPLK

SEQ ID NO: 5010 - protein, 35 aa, Homo sapiens
MLSIMLCFLWNMIILLVASSAYSGCDLALPGTSAL

SEQ ID NO: 5011 - protein, 38 aa, Homo sapiens
MGKSVLLGSIYYLLLSSHLCKSAISTKMCDRRSQRILL

SEQ ID NO: 5012 - protein, 41 aa, Homo sapiens
MYMKMMFMLFIILPFIISFFIVLIAMSFSSLIFFPQCLICH

SEQ ID NO: 5013 - protein, 24 aa, Homo sapiens
MAASALLLCVVTLILFLVLHYIVS

SEQ ID NO: 5014 - protein, 8 aa, Homo sapiens
MSNVQLQR

SEQ ID NO: 5015 - protein, 24 aa, Homo sapiens
SFFVFLGDLYFFFGEMSIPILAHF

SEQ ID NO: 5016 - protein, 16 aa, Homo sapiens
GPCDPISWLLRLLSLF

SEQ ID NO: 5017 - protein, 65 aa, Homo sapiens
GSFPSPKHRQRGGEQFLVLFLFLKWCLYLQPPGGLPWPHFSAPPRHRHPSTLLHVTRKMPFAECT

SEQ ID NO: 5018 - protein, 90 aa, Homo sapiens
MCPVSQFPGSSSVCCPFSSSGSIVREPRMEAKCTGHWLFFQCPSDSPCPGGLVPSLSVWCLFYKLVMTSGNGPGFQIAIPGDILILWFKP

SEQ ID NO: 5019 - protein, 33 aa, Homo sapiens
MYYFIFLFFSYVLCFRIFLEASSKSCFVGNKQS

SEQ ID NO: 5020 - protein, 40 aa, Homo sapiens
IDFFLFPTISSASPFSSFKINPESDHCGLNHYYILPELLQ

SEQ ID NO: 5021 - protein, 35 aa, Homo sapiens
MGWVIALCSQLSRLLTLFLLRLFLNRKIRILSFQQ

SEQ ID NO: 5022 - protein, 34 aa, Homo sapiens
MGLLLWLSVGHTSPQKAPAKELRFWLGKNITPLQ

SEQ ID NO: 5023 - protein, 15 aa, Homo sapiens
MPALIDGAERHCIPI

SEQ ID NO: 5024 - protein, 37 aa, Homo sapiens
MLLIFTFSALVLSYPLLILGDWVEMAIEHHTLLTKTI

SEQ ID NO: 5025 - protein, 30 aa, Homo sapiens
MALVGLLSAGVPGVSLCVQIFSYKDTGEIG

SEQ ID NO: 5026 - protein, 2 aa, Homo sapiens
ML

SEQ ID NO: 5027 - protein, 39 aa, Homo sapiens
MFFHFGVNIAWIFFLVPRLAFSSGNLAVKINLFQMKYCI

SEQ ID NO: 5028 - protein, 12 aa, Homo sapiens
VLLLPHVLSGGL

SEQ ID NO: 5029 - protein, 35 aa, Homo sapiens
LIVFHIIFIPWITLLCVFIGVRLLAVSYETTYYIF

SEQ ID NO: 5030 - protein, 19 aa, Homo sapiens
MTSYCSFDLHFSDDNYVEH

SEQ ID NO: 5031 - protein, 34 aa, Homo sapiens
MNFWHSCYLLRNCTVCFLCSIFFFFPGMRMYLSS

SEQ ID NO: 5032 - protein, 34 aa, Homo sapiens
MKLTLGTAGSLFPQALYILLDFIWVNFIDGSHYI

SEQ ID NO: 5033 - protein, 48 aa, Homo sapiens [sequence omitted]

SEQ ID NO: 5034 - protein, 9 aa, Homo sapiens
MNKIKKWLI

SEQ ID NO: 5035 - protein, 35 aa, Homo sapiens
MLGSSPLMLIWATTFVRSSIACSLSALFSPRNTFL

SEQ ID NO: 5036 - protein, 22 aa, Homo sapiens
MVRLSSLQTLLCPDSHLGHFIQ

SEQ ID NO: 5037 - protein, 20 aa, Homo sapiens
MELFFFWLTILLFPTVFNNC

SEQ ID NO: 5038 - protein, 41 aa, Homo sapiens
MGNVMVTFSRLSCLIPSASSLLCLNSCTGCLVHVHITKRWY

SEQ ID NO: 5039 - protein, 37 aa, Homo sapiens
MKSALRLVLLFSFHFFPLIISFRRKREGKKKKKIRDL

SEQ ID NO: 5040 - protein, 44 aa, Homo sapiens
MNHTLRNQCGCPLRVLLFFLLPLSKIRYSVIKYISIKVFKSDLY

SEQ ID NO: 5041 - protein, 40 aa, Homo sapiens
MSKGLRKESHVFFLLFSNLVITKQCYQCITYKHFIIHFHF

SEQ ID NO: 5042 - protein, 50 aa, Homo sapiens
MLTFLVWQAELVLLPTLPFPIVTIYRTSHCCLLCVASASLPGRSRNLRIS

SEQ ID NO: 5043 - protein, 42 aa, Homo sapiens
ALETVVHFILLSLLVFMYDLLIGKNLIMVSLMTNQFVLNTFY

SEQ ID NO: 5044 - protein, 17 aa, Homo sapiens
MVITVATLVSLLIDASG

SEQ ID NO: 5045 - protein, 6 aa, Homo sapiens
STILCF

SEQ ID NO: 5046 - protein, 33 aa, Homo sapiens
MEIIYVTLLINVVVVHACNSWRSLRQMSPKYST

SEQ ID NO: 5047 - protein, 20 aa, Homo sapiens
MTRGTLPPTLLGLSFLSSQL

SEQ ID NO: 5048 - protein, 138 aa, Homo sapiens
MEKINFLVEIQWLTKPSLILSQPAQLRPVRRLPATITRLAVAMTPGQPGVPPNLGTGKAQKAGGPSQRGLEPKETQTLPTTGTLPSATPRPTKDQQLVMMMTGMKTGMGPNPLPTLRIQSQLMQAALSEETVVLVPHP

SEQ ID NO: 5049 - protein, 58 aa, Homo sapiens [sequence omitted]

SEQ ID NO: 5050 - protein, 5 aa, Homo sapiens
MRECS

SEQ ID NO: 5051 - protein, 29 aa, Homo sapiens
MAGLVLVFLGILLFEAQHSQRNPQDAAGR

SEQ ID NO: 5052 - protein, 3 aa, Homo sapiens
PPR

SEQ ID NO: 5053 - protein, 12 aa, Homo sapiens
MKLLIVIFFHFL

SEQ ID NO: 5054 - protein, 62 aa, Homo sapiens
MLFSLLHLGFCAYESNLILFQMAIPIPGQLVKKSFFPSLIWVAGTGPVPVSSGAYPTLFSLQ

SEQ ID NO: 5055 - protein, 4 aa, Homo sapiens
QVWL

SEQ ID NO: 5056 - protein, 46 aa, Homo sapiens
TRQRLKALSLRNCVTLVTLFDFSLLKFSHMGMVRKIPTSQDFLTIL

SEQ ID NO: 5057 - protein, 34 aa, Homo sapiens
MAALLLPLHLCLCAPDVSLCVSKHHLIRTPVGTD

SEQ ID NO: 5058 - protein, 24 aa, Homo sapiens
MSITLLFAVLTLLCNGTPELILPV

SEQ ID NO: 5059 - protein, 35 aa, Homo sapiens
MKHFCNLLCILMFCNQQSVCDPPSQNNAGKINLRY

SEQ ID NO: 5060 - protein, 35 aa, Homo sapiens
MLGSKASLRILLCLFFFLPRHSSSDNCCPSCTAGG

SEQ ID NO: 5061 - protein, 24 aa, Homo sapiens
FWWVCGLAGFRSEATDLHGECCSS

SEQ ID NO: 5062 - protein, 28 aa, Homo sapiens
KKISLSLLFFCSLLKSKQNLLLSPVNTT

SEQ ID NO: 5063 - protein, 21 aa, Homo sapiens
MRREPKAQLSVSCLAAMSFLY

SEQ ID NO: 5064 - protein, 17 aa, Homo sapiens
  SITE (9): Xaa equals any amino acid
GVVAVVVFXFSSLLFRF

SEQ ID NO: 5065 - protein, 10 aa, Homo sapiens
LVLFVIKGTI

SEQ ID NO: 5066 - protein, 28 aa, Homo sapiens
MFGWCHHLFFCMLFSLWRGHLCVYRRKM

SEQ ID NO: 5067 - protein, 31 aa, Homo sapiens
MRGAWCVCLCVCVYGYNSFIFVASERLCRAL

SEQ ID NO: 5068 - protein, 37 aa, Homo sapiens
HLPSIIPVLVYVLPKRAWKFILAVSLCWADYPIKVPL

SEQ ID NO: 5069 - protein, 177 aa, Homo sapiens
MGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKNGWTWPG

SEQ ID NO: 5070 - protein, 93 aa, Homo sapiens
MESQYVSFCVWLLSLSVLFSKSIRAAPYMSALFHPCCTIHERFIPSMLCHTSALYSIHAVPYISALFHPCCTIHERFIPSVLHHTSVLYSFSG

SEQ ID NO: 5071 - protein, 13 aa, Homo sapiens
PSLVSCASLLTVM

SEQ ID NO: 5072 - protein, 24 aa, Homo sapiens
MHYILKYSMTGFCPCLWAFIFLMG

SEQ ID NO: 5073 - protein, 27 aa, Homo sapiens
MCIILLVVVFHKSQFSSLVVGPKSSVS

SEQ ID NO: 5074 - protein, 18 aa, Homo sapiens
MTTWPIRPGIFAVWLYAV

SEQ ID NO: 5075 - protein, 54 aa, Homo sapiens
  SITE (16): Xaa equals any amino acid
  SITE (25): Xaa equals any amino acid
  SITE (43): Xaa equals any amino acid
MHYVCSFLKKILIVFXCSVPCLFSXVCPVTLSILDYKLIKALXMLFSLFLNLNI

SEQ ID NO: 5076 - protein, 78 aa, Homo sapiens
MYLLSTYLLWCSTLVTASYLNFPRVVPYSVFSDMVFQSVCVTYLLFISHCRWLCLLHHHKKFKLCALINCVLLKRLVG

SEQ ID NO: 5077 - protein, 3 aa, Homo sapiens
LNL

SEQ ID NO: 5078 - protein, 33 aa, Homo sapiens
MLGSLMARLNMLVPSSWAGSLASAPMIATAAIK

SEQ ID NO: 5079 - protein, 37 aa, Homo sapiens
MANLPLILIMLVVGMMGVTINTLSTHVQTLFQAVFIY

SEQ ID NO: 5080 - protein, 38 aa, Homo sapiens
MKKPSASKMHTLILPIALLLAGPVQLTHFSGTAADSLL

SEQ ID NO: 5081 - protein, 22 aa, Homo sapiens
MATHLFIYLLVAVFCYSCSVLY

SEQ ID NO: 5082 - protein, 12 aa, Homo sapiens
RLCRSFTFCFCS

SEQ ID NO: 5083 - protein, 53 aa, Homo sapiens
MRIVSDSCFSFPFSPPLSDTYTPRPHHTYAHCGLHHSHSLYFVNLAARKFLSP

SEQ ID NO: 5084 - protein, 64 aa, Homo sapiens [sequence omitted]

SEQ ID NO: 5085 - protein, 38 aa, Homo sapiens
MTSARKACFCFMWSLILQHAHSTCSWLGKVPTDIYKAS

SEQ ID NO: 5086 - protein, 21 aa, Homo sapiens
MILFFCWAPICFFLCNESLKE

SEQ ID NO: 5087 - protein, 26 aa, Homo sapiens
MPPGCLAVTECLFLLAYWSHVIFVTW

SEQ ID NO: 5088 - protein, 10 aa, Homo sapiens
MIHTPHNSPI

SEQ ID NO: 5089 - protein, 69 aa, Homo sapiens
  SITE (52): Xaa equals any amino acid
MSERHGPSPQSVLLSLWFVLTLTPFLFLTLLSCMEHTAPAPFQSAWQTPGLXRSSSFCVPFRSSLCSVR

SEQ ID NO: 5090 - protein, 30 aa, Homo sapiens
MRAELHGLVCLSAVSTMTAAVSGTEMPNIC

SEQ ID NO: 5091 - protein, 31 aa, Homo sapiens
DTLLSPWLLVWYVRLPAVFPFLNSTAGSSLK

SEQ ID NO: 5092 - protein, 46 aa, Homo sapiens
MASSVTTISLLLLASFTSLSCVWYFMFSCQDCVDLQILSLPDEVIC

SEQ ID NO: 5093 - protein, 34 aa, Homo sapiens
MAIHIWTMYFRLLHLYTLVPSAGGWGVCACIPRQ

SEQ ID NO: 5094 - protein, 32 aa, Homo sapiens
DFLLLIEWFISLKTFEMAHELLGQIMETSTLL

SEQ ID NO: 5095 - protein, 33 aa, Homo sapiens
MPILSHWTYVDWFLLLLCTYKYIYKMNIVHAFR

SEQ ID NO: 5096 - protein, 26 aa, Homo sapiens
  SITE (2): Xaa equals any amino acid
MXWLKLSFFVWAPVLTVLQCSWQVEW

SEQ ID NO: 5097 - protein, 32 aa, Homo sapiens
MNHLLILLTKHLIHTQMLEFPLYKCSHAIQLF

SEQ ID NO: 5098 - protein, 119 aa, Homo sapiens
MCYRRSLLKVLMSIYLLYKAIYATGSLKIQYCSSSKRSTKPRVSSLISLYSKNDPSMGWLNTDIEGILPQKIHLFVAGNFPLLSCVISFLLLATTHHWGLWKIIFLFGNEWKSKRPYYF

SEQ ID NO: 5099 - protein, 17 aa, Homo sapiens
MTKSVFFSFLSLSLSLG

SEQ ID NO: 5100 - protein, 56 aa, Homo sapiens
MWKENISFSFFIKIQVILLLYEQFFLIGHVAKNTAYSKCVSCCHDVYPYNNSVTKV

SEQ ID NO: 5101 - protein, 89 aa, Homo sapiens
LGLWPIWYASCVCMVCAVSLHLFYTSWGHGPQLLDRTLFSNPALGDQPSLANICMFSYSCLLKGPTQRLDFLLPLCVGTVCDICKKCAN

SEQ ID NO: 5102 - protein, 30 aa, Homo sapiens
MNASILYLCLVSFCLSIQEAFIKGPPCASH

SEQ ID NO: 5103 - protein, 40 aa, Homo sapiens
LRVATLPGVPLPRDYGQGPGAGRAAGADTGAAPESGNSAS

SEQ ID NO: 5104 - protein, 36 aa, Homo sapiens
MMDALVFLPWFVSSTRACAPRICCNLILVKRPSVSS

SEQ ID NO: 5105 - protein, 40 aa, Homo sapiens [sequence omitted]

SEQ ID NO: 5106 - protein, 22 aa, Homo sapiens
MLLSPFIFCFFLITVGLIENWS

SEQ ID NO: 5107 - protein, 65 aa, Homo sapiens
MNLSKAPALRFLWSCSSITGAAGNLNTTSWSTRLWPNGRRKKLSSGWSSWALGHLFTGKGFYLNE

SEQ ID NO: 5108 - protein, 34 aa, Homo sapiens
MVYRIQHADTWWDLLLLGFCYTRVSVVSASIYVC

SEQ ID NO: 5109 - protein, 47 aa, Homo sapiens
MVYRIQHADTWWTYCYWGFVILGFQWSVLVFMYVNPRCALDSGYFKF

SEQ ID NO: 5110 - protein, 2 aa, Homo sapiens
MV

SEQ ID NO: 5111 - protein, 85 aa, Homo sapiens
MPWLNQVLRAASLSPRCLVWVPVLGFLGPGLPPVLQTFPTGNPGYHPCPPEELPPPGLSPVGPGGAGGTTGTCGAWECLSCCIGP

SEQ ID NO: 5112 - protein, 144 aa, Homo sapiens
  SITE (77): Xaa equals any amino acid
SVLWNAMIHPLCNMTLKGVVWYQGESNINYNTDLYNCTFPALIEDWRETFHRGSQGQTERFFPFGLVQLSSDLSKKXSDDGFPQIRWHQTADFGYVPNPKMPNTFMAVAMDLCDRDSPFGSIHPRDKQNCGLSAAFGGPCSGLW

SEQ ID NO: 5113 - protein, 13 aa, Homo sapiens
MSPTQRCPILSWL

SEQ ID NO: 5114 - protein, 26 aa, Homo sapiens
MMMLTLYYCKINVVYISLCTAIFCFW

SEQ ID NO: 5115 - protein, 40 aa, Homo sapiens
MSAALLSSSLCWLRTLAYRPTNNQEAALVGTHCSKQGKQV

SEQ ID NO: 5116 - protein, 20 aa, Homo sapiens
MHVSVFVLMLLLPWQRKKKE

SEQ ID NO: 5117 - protein, 63 aa, Homo sapiens
MECSLTLAGLTLALPVGLPAAKTESLHCSFSPVTRPVYGPNGHASENLPWPLSKPSPGCNPCF

SEQ ID NO: 5118 - protein, 6 aa, Homo sapiens
ASCLCV

SEQ ID NO: 5119 - protein, 33 aa, Homo sapiens
MLRFCMLLQVLFHMCVCGVDVELLTTAAITYCS

SEQ ID NO: 5120 - protein, 13 aa, Homo sapiens
FFFFFFSQRLTKL

SEQ ID NO: 5121 - protein, 40 aa, Homo sapiens
MRRNMMNPLTFMLLGCACLRWLHLNILTRSAKMLRRSTVA

SEQ ID NO: 5122 - protein, 14 aa, Homo sapiens
  SITE (12): Xaa equals any amino acid
MSRVQSWCPAWXRW

SEQ ID NO: 5123 - protein, 207 aa, Homo sapiens
  SITE (170): Xaa equals any amino acid
ARAAVVVPAEWIKNWEKSGRGEFLHLCRILSENKSHDSSTYRDFQQALYELSYHVIKGNLKHEQASNVLSDISEFREDMPSILADVFCILDIETNCLEEKSKRDYFTQLVLACLYLVSDTVLKERLDPETLESLGLIKQSQQFNQKSVKIKTKLFYKQQKFNLLREENEXYAKLIAELGQDLSGSITSDLILENIKSLIGCFNLGSQ

SEQ ID NO: 5124 - protein, 33 aa, Homo sapiens
MLLLTMGFIQILPVFLLVYFFYSRVQSKIPHCI

SEQ ID NO: 5125 - protein, 8 aa, Homo sapiens
MGLVLEWC

SEQ ID NO: 5126 - protein, 36 aa, Homo sapiens
MFLLAILLPVFLVAWGGKTKESGWRAEGCRAVTLLL

SEQ ID NO: 5127 - protein, 29 aa, Homo sapiens
MAFLTMRILFFAYSFSKKHFLMEISEHGH

SEQ ID NO: 5128 - protein, 28 aa, Homo sapiens
MPVTELLQLLLLTQKMKRLLDWQQNKVE

SEQ ID NO: 5129 - protein, 61 aa, Homo sapiens [sequence omitted]

SEQ ID NO: 5130 - protein, 31 aa, Homo sapiens
MGRCVWMHFSCSCCFAFPDSTIPRGRGWSIL

SEQ ID NO: 5131 - protein, 338 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTVSFLRQNLPGRYLSMFNILKK

SEQ ID NO: 5132 - protein, 17 aa, Homo sapiens
MMRLLLWLMIPWKASMK

SEQ ID NO: 5133 - protein, 54 aa, Homo sapiens [sequence omitted]

SEQ ID NO: 5134 - protein, 379 aa, Homo sapiens
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 5135 - protein, 188 aa, Homo sapiens
QGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRGPRGRPAAAAGLWSVRTSAWRLSWRGGALSWSSGGGWTRSWAPVPRRCLLQPHSPPPCPGSPSAGVASWTW

SEQ ID NO: 5136 - protein, 16 aa, Homo sapiens
LTGVGLSSLCSWQCSH

SEQ ID NO: 5137 - protein, 34 aa, Homo sapiens
MHVFHSSPLPVYSGGWCSLLVLLSLAERTMGSST

SEQ ID NO: 5138 - protein, 12 aa, Homo sapiens
HLLFLLLCFTCK

SEQ ID NO: 5139 - protein, 63 aa, Homo sapiens
MSWAPLQPGVCSCGVEVGGAGRDLQGSSCEGDSAATCRTLPLCLLPAWNMDVMAGAGTAVLRA

SEQ ID NO: 5140 - protein, 318 aa, Homo sapiens
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 5141 - protein, 36 aa, Homo sapiens
MDLKGRTKCSQYFLLSVVLLLSMGIVGSIIETLGKL

SEQ ID NO: 5142 - protein, 109 aa, Homo sapiens
MELTIFILRLAIYILTFPLYLLNFLGLWSWICKKWFPYFLVRFTVIYNEQMASKKRELFSNLQEFAGPSGKLSLLEVGCGTGANFKTPSQKKKKKKRSRDRETGSHCVA

SEQ ID NO: 5143 - protein, 32 aa, Homo sapiens
MMVIIVKKILLIVLRESTTLCQIPCFFLKPLK

SEQ ID NO: 5144 - protein, 73 aa, Homo sapiens [sequence omitted]

SEQ ID NO: 5145 - protein, 34 aa, Homo sapiens
MIAQLQSPCSFYLIMLALFSMSVWTHIKTPSCTL

SEQ ID NO: 5146 - protein, 69 aa, Homo sapiens
MASLWLVSWDLLLLLSHDCRLARIWLWMAWTQASRSSYVVASKCHVWPVADTIIKLLVLFFFRCFFLLA

SEQ ID NO: 5147 - protein, 98 aa, Homo sapiens
MLAMKLLVLWTVVCPQLVFLQKQLHKTTPNLPQSSQELVSDQRVRQSPRPQKLLFLPAPRQFHRLPSRGRTTAKVSSSTSGTKWSWGLCYGTSLTECQ

SEQ ID NO: 5148 - protein, 38 aa, Homo sapiens
MSVCVLYLQSLVIVPYITCKQILYFILAYLTEHITQKK

SEQ ID NO: 5149 - protein, 46 aa, Homo sapiens
MPGKQDWLFLQKNRTVPYIWPVQLVYLMPMFLLRVMHAYHLFQRRD

SEQ ID NO: 5150 - protein, 38 aa, Homo sapiens
MCHHTQLSSFLLNFFSEFSTLLVLTAISMFCFSLVTYA

SEQ ID NO: 5151 - protein, 23 aa, Homo sapiens
MFVAVFLFCFVFCKFHSAISVFN

SEQ ID NO: 5152 - protein, 217 aa, Homo sapiens
  SITE (156): Xaa equals any amino acid
  SITE (196): Xaa equals any amino acid
  SITE (211): Xaa equals any amino acid
MLPVVWIILCSSAQFPHLWKLHSHLAQMSHSSLLPLENRSLSLCRTRCSDPLSCTLAPFLPPTVSLSTLSSALQSSFCSFFLRRQCRPSCSPVPGVHISNFGSASWTCPCGCLAIHSNPASPKGMILPYFLLTQLCGQSSRTNGSKLPPNTHPRLXAWAPLASPRAAHIKVQLGSELLQEASPALLCRRTLLLHTXSPILWQALLYPQASXQTSLTC

SEQ ID NO: 5153 - protein, 35 aa, Homo sapiens
MMSTSQTAPLWCLWPPSRMTLAVSLSPASRRRGSR

SEQ ID NO: 5154 - protein, 40 aa, Homo sapiens
MKHFLFFSFLAFLSLYLMYTWKLQGLSTGHASLYRSHLCL

SEQ ID NO: 5155 - protein, 35 aa, Homo sapiens
MENMYWGPLGLTSEIVLFILLHLAFQLMEKYKFKF

SEQ ID NO: 5156 - protein, 34 aa, Homo sapiens
QKLLLFYAQSDIESFHLFLSPLLLLSDMLLQFLT

SEQ ID NO: 5157 - protein, 44 aa, Homo sapiens
GLGSGEWFPALQLMWLLRGTQALFHYLPNNGGPVFNCSTTTQNT

SEQ ID NO: 5158 - protein, 31 aa, Homo sapiens
MLLRVRRVGIICHLEFLCLADLSSDLPIYQR

SEQ ID NO: 5159 - protein, 46 aa, Homo sapiens
MSPGGFLLLTSLGPTIGFLAGLRSLREVAISKRKDFYLRLSGKEAE

SEQ ID NO: 5160 - protein, 23 aa, Homo sapiens
MSQSLIINLFLCIYILLVLSGEP

SEQ ID NO: 5161 - protein, 46 aa, Homo sapiens
MMILFCQLLAVSWGCCVYSTTNPKVSAIHCGFIEHLLVCACVGGGI

SEQ ID NO: 5162 - protein, 48 aa, Homo sapiens
MCVQKRQLPIGPRSHFLMVLILFMQPVPFVHISWLVNKATSDLFFKDL

SEQ ID NO: 5163 - protein, 37 aa, Homo sapiens
  SITE (2): Xaa equals any amino acid
MXFWAAMGLLEHWCVHLHSMCWNPQESGGAHIQGKVS

SEQ ID NO: 5164 - protein, 37 aa, Homo sapiens; identical to SEQ ID NO: 5163
  SITE (2): Xaa equals any amino acid

SEQ ID NO: 5165 - protein, 59 aa, Homo sapiens
MLARLRQVSTLCCLSLAQTGHFVWLFPSTRPQWEQASLPQASETDHPIPPSPVNLPLFP

SEQ ID NO: 5166 - protein, 24 aa, Homo sapiens
LFHITEWDLCFEETNPTDTLILDF

SEQ ID NO: 5167 - protein, 56 aa, Homo sapiens
MKSHSVWLPTLYCAVVKVYLCVGCSHPLVSTGIGPRSLHRSPAGMPVSHSAPCKTH

SEQ ID NO: 5168 - protein, 52 aa, Homo sapiens
MILMSLLPIFWLVTPLHIISSSPFVLCVLWGVCVCVCVCVVGEGCFRNEREK

SEQ ID NO: 5169 - protein, 477 aa, Homo sapiens
  SITE (19): Xaa equals any amino acid
  SITE (64): Xaa equals any amino acid
  SITE (73): Xaa equals any amino acid
  SITE (76): Xaa equals any amino acid
  SITE (90): Xaa equals any amino acid
  SITE (112): Xaa equals any amino acid
  SITE (141): Xaa equals any amino acid
  SITE (181): Xaa equals any amino acid
  SITE (341): Xaa equals any amino acid
MALRHSACRRFSLAEFAQXQARARHEKLRQRLKEEKLEMLQWKLSAAGVPQAEAGLPPVVDAIXDASVEEDLXVAXAGGRLEEVSFLQPXPARRRRALLRASGVRRIDREEXRELQALRQSREDCGCHCDRICDPETCSCXLAGIKCQMDHTAFPCGCCREGCENPMGRVEFNQARVQTHXIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGXLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 5170 - protein, 8 aa, Homo sapiens
GGLWLSLR

SEQ ID NO: 5171 - protein, 2 aa, Homo sapiens
SL

SEQ ID NO: 5172 - protein, 17 aa, Homo sapiens
LIFIVFHTSSQSLPGTW

SEQ ID NO: 5173 - protein, 18 aa, Homo sapiens
  SITE (5): Xaa equals any amino acid
MPGFXWFVFVFVFLSNPA

SEQ ID NO: 5174 - protein, 629 aa, Homo sapiens
MCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 5175 - protein, 34 aa, Homo sapiens
MYVCACVFVCAYCVHMCVSRLCVSFWGMCVSVLL

SEQ ID NO: 5176 - protein, 16 aa, Homo sapiens
MTELLLFFSPLYQEVN

SEQ ID NO: 5177 - protein, 2 aa, Homo sapiens
MS

SEQ ID NO: 5178 - protein, 15 aa, Homo sapiens
MSNWWRWGLLLWPPQ

SEQ ID NO: 5179 - protein, 60 aa, Homo sapiens
VITMALAAVVTEVALANLNVVETVAGVTNQMKMIGQNHSHQVNAWNSKFLKCMLLVMKPY

SEQ ID NO: 5180 - protein, 47 aa, Homo sapiens
PTLTAPTLALLLLPKISCLLTSTHPRTQGSRAHFPRAWRTPQTPSSM

SEQ ID NO: 5181 - protein, 27 aa, Homo sapiens
MASTSRWTRWALLLASSSAWPNSTAPS

SEQ ID NO: 5182 - protein, 51 aa, Homo sapiens
MAFLSLFPLSSLFSHFSLFKTCLQSTQNRVDKSLSSPDFSWPRNERLFSKP

SEQ ID NO: 5183 - protein, 30 aa, Homo sapiens
ISMFSLLVKMCVQMTVGRDARCKFTSLPSL

SEQ ID NO: 5184 - protein, 9 aa, Homo sapiens
MGTRLGDFC

SEQ ID NO: 5185 - protein, 31 aa, Homo sapiens
MLCVHFSARESVAFLCLSKGSTVQNSLAPLT

SEQ ID NO: 5186 - protein, 68 aa, Homo sapiens
  SITE (32): Xaa equals any amino acid
ILATPQPLVVPHAHFAEDEPQVLIRCWNKPPXLSESPTNLEFETHSLARLNGLCSAIKRLLGCYPWQG

SEQ ID NO: 5187 - protein, 75 aa, Homo sapiens
MSALPSPLCPFCSVLLLPSPPARVPGLCLLFLSLPPLTPPSTVGTCKPQGCAPSWSPIHPRNVSCSIYKGHGDFG

SEQ ID NO: 5188 - protein, 41 aa, Homo sapiens
MTYLLFLSELDTLCPGQPCPWAATAHQSWEEAGPGGLGRRQ

SEQ ID NO: 5189 - protein, 12 aa, Homo sapiens
MGSSLAFILFLP

SEQ ID NO: 5190 - protein, 8 aa, Homo sapiens
GLSYFLDH

SEQ ID NO: 5191 - protein, 99 aa, Homo sapiens
MRLGRWGLRMWPWRVLFLAGASPSQLQEMGCRCTSTAQSSAGEGSKTSLHPDPRVCRSFQLLAPWRMGREGERGRWVEDSTGAWPHDGCNAATFSVGHV

SEQ ID NO: 5192 - protein, 19 aa, Homo sapiens
AFINSCIFFPLFLLAYYVY

SEQ ID NO: 5193 - protein, 20 aa, Homo sapiens
DSFIGEWVVALGKVLPYCLF

SEQ ID NO: 5194 - protein, 42 aa, Homo sapiens
  SITE (34): Xaa equals any amino acid
MKGHYPCAWMSLSWFRTLSAMIYCLLYIDKSSIXFFTNERRI

SEQ ID NO: 5195 - protein, 32 aa, Homo sapiens
MGCELWISAAWISAVWCSNRLHNLVESQSSHL

SEQ ID NO: 5196 - protein, 19 aa, Homo sapiens
DKFLIFSYFCLCLFMPLIP

SEQ ID NO: 5197 - protein, 26 aa, Homo sapiens
MPWYFSPSLLWSLFQWSDSEAGSRLC

SEQ ID NO: 5198 - protein, 35 aa, Homo sapiens
MSLPMSFFILSHLSSFMICTYGKDYSHFTDEGAFT

SEQ ID NO: 5199 - protein, 52 aa, Homo sapiens
MPLAIFALVDLFWVSSFSNINVPKDHLVKCLRFRVLSHPERSGLNRSRNLHF

SEQ ID NO: 5200 - protein, 38 aa, Homo sapiens
MYMQHVLLCLMYISMSFNKFILSCNNHHDQFTERFHLL

SEQ ID NO: 5201 - protein, 20 aa, Homo sapiens
MSWLRIILSMLKTAFEPRSV

SEQ ID NO: 5202 - protein, 55 aa, Homo sapiens
MCTSFMQLWFVLGLADLGWAWLQAICLVHVCSLHLSLFWDQQVTQGMLPSWPWKN

SEQ ID NO: 5203 - protein, 31 aa, Homo sapiens
MLLILFFIQVTGCIREMVWAFKGITEKGISY

SEQ ID NO: 5204 - protein, 6 aa, Homo sapiens
AGAVFG

SEQ ID NO: 5205 - protein, 44 aa, Homo sapiens
MFSLLRAFPSDRCPCPAASTGWQRARASAPKLSCRALRPRVCPQ

SEQ ID NO: 5206 - protein, 34 aa, Homo sapiens
MPSLIFIISFFLLAVDLVCPSFSCSLRCAGNLFL

SEQ ID NO: 5207 - protein, 74 aa, Homo sapiens
MRSSLWSSSSLLSLMANFPAQTSASGLFPSVHTDFFPSPVPSWRVGPSAAALGHSQDKVLVYLGEQITSSSIHT

SEQ ID NO: 5208 - protein, 36 aa, Homo sapiens
  SITE (15): Xaa equals any amino acid
MCICVFYMIYIYLYXMFTYKVGSQTWKDFPYHTKEI

SEQ ID NO: 5209 - protein, 67 aa, Homo sapiens [sequence omitted]

SEQ ID NO: 5210 - protein, 17 aa, Homo sapiens
ICIWNISYMNMYFFTQQ

SEQ ID NO: 5211 - protein, 42 aa, Homo sapiens
MSPVLHLRRLARCILFHLPQFSSSVKRPHGFGANRMTDKRDK

SEQ ID NO: 5212 - protein, 35 aa, Homo sapiens
MYLLINKLYIFCMFTQTVLVLESPHHLNFVGEFCK

SEQ ID NO: 5213 - protein, 55 aa, Homo sapiens
  SITE (33): Xaa equals any amino acid
MWLTKKFKLNVRLTFCFYWTAQVEKVSEHKTPXKYIFHWDWGWVLWGKCIGAGQC

SEQ ID NO: 5214 - protein, 92 aa, Homo sapiens
MSDAPLGVWVLLQAVRCSPGCVGTAPDSPMLTCGCGCCSRPSDAHLGVWVLLQVVRCSPWAMGAATCCQMLTSGCGHCSGLSDARLWLWALL

SEQ ID NO: 5215 - protein, 83 aa, Homo sapiens
PLQSSPWRLLFRGHLPVLSGGSVPASAPGSHPCPAHEGAHPWTYLSSPTTSLAFNGSGIRDRGATRQRAPGGLMGGRGKSRHC

SEQ ID NO: 5216 - protein, 38 aa, Homo sapiens
MCVGKDFFWFLLFGFAQILESVGLHLLPNLKSFLSLFL

SEQ ID NO: 5217 - protein, 54 aa, Homo sapiens
MRRCTLEGNRWLLFLCVVWNGWQKVSELCGRQHGAKGTVSPSSPLPLSQTPADI

SEQ ID NO: 5218 - protein, 22 aa, Homo sapiens
TSLILCCLSTYLLSLYCGPCTY

SEQ ID NO: 5219 - protein, 41 aa, Homo sapiens
MDILFFFLFYFLQERLGFSTVSNKSSGVIFFPVVLPQPPES

SEQ ID NO: 5220 - protein, 35 aa, Homo sapiens
MCIAIVHSLSLPYGTPLYEPSIYCIYGCGTNYPKT

SEQ ID NO: 5221 - protein, 71 aa, Homo sapiens
MNWRSCKLGSVYYYRFCTVSPRVLVKQDGGRGTSFPSFTSLRSIFSIFYNFAFGKGLLISWEFRHILKISP

SEQ ID NO: 5222 - protein, 4 aa, Homo sapiens
MVSC

SEQ ID NO: 5223 - protein, 35 aa, Homo sapiens
MPGSCFSWSFSRLLGVFLSLQCSWKTVYGILSREA

SEQ ID NO: 5224 - protein, 31 aa, Homo sapiens
MGHIFWMCALKLILLARRKKGDASVSNILDT

SEQ ID NO: 5225 - protein, 23 aa, Homo sapiens
MLHFYTIKFIFSIVCLLAPIGSR

SEQ ID NO: 5226 - protein, 29 aa, Homo sapiens
MYLIFVYCVVLFFVSALTGVAGGAPSEMH

SEQ ID NO: 5227 - protein, 20 aa, Homo sapiens
MIKLNTSFSIFNAAMLLYLW

SEQ ID NO: 5228 - protein, 35 aa, Homo sapiens
MNNPQSPGLILFTWLSCLFAFRSVLASSLSKRIRA

SEQ ID NO: 5229 - protein, 38 aa, Homo sapiens
MHRRDLSVCVCLCLCPSLSLSLCKTRIHCCRELPQIAP

SEQ ID NO: 5230 - protein, 68 aa, Homo sapiens
  SITE (22): Xaa equals any amino acid
MWHMMSFTPCSLPCSLALCLPXGPACLPPVPLPLTSNIQLKAKAGLLLRQRLCSIASVHLPALLVSAR

SEQ ID NO: 5231 - protein, 32 aa, Homo sapiens
MYVRLNVTYYLGLFFKLKFALALQPARQGVIT

SEQ ID NO: 5232 - protein, 54 aa, Homo sapiens
MLPNIVLPSWCLVCLVQFSFTFLSPSHSPRIVTTGLYTPGRHEPNLLSCSLLHL

SEQ ID NO: 5233 - protein, 6 aa, Homo sapiens
MRTRLW

SEQ ID NO: 5234 - protein, 9 aa, Homo sapiens
  SITE (6): Xaa equals any amino acid
MAAIGXNGF

SEQ ID NO: 5235 - protein, 25 aa, Homo sapiens
MALNWLTLLLTWTFESYVVTYFPHL

SEQ ID NO: 5236 - protein, 23 aa, Homo sapiens
  SITE (11): Xaa equals any amino acid
MCADLPGPVGXADVGPGSYPGIW

SEQ ID NO: 5237 - protein, 64 aa, Homo sapiens
HMHTAVAHTSLSLSLVTVLPCDSHPSDRPCSLAAPSTGRGLAWCPVSVCLHRAGRFHKDWLMSR

SEQ ID NO: 5238 - protein, 5 aa, Homo sapiens
MALPT

SEQ ID NO: 5239 - protein, 32 aa, Homo sapiens
MGSPGALLALLPSLLPFSWGLGPWPLLSSPKT

SEQ ID NO: 5240 - protein, 36 aa, Homo sapiens
MFIWVGVSLCLMFTVAIDARDFRFLSCPNFYLPFDF

SEQ ID NO: 5241 - protein, 18 aa, Homo sapiens
MTIPSLNDFVCRILLLLN

SEQ ID NO: 5242 - protein, 57 aa, Homo sapiens
KSARIRIFLIPLCSTSLPIPKFLPLGRKFLLLLFDLIFNSISMIFCFVFFFLRMTVF

SEQ ID NO: 5243 - protein, 43 aa, Homo sapiens
NCNLLFACIVILVYALFDISCLPYLYLKYSKYLFLYIFGKNIF

SEQ ID NO: 5244 - protein, 56 aa, Homo sapiens
  SITE (16): Xaa equals any amino acid
  SITE (21): Xaa equals any amino acid
  SITE (54): Xaa equals any amino acid
MGRFWAWHIIASLLLXHTIFXRNNSESQEVKENAISTLCRIERHLTNRCGSQIXIF

SEQ ID NO: 5245 - protein, 6 aa, Homo sapiens
WMHTGH

SEQ ID NO: 5246 - protein, 49 aa, Homo sapiens
FFAFLGPFPFTLISLSRGLQFPHNRFDRRKILNWEAHRGKRTAFLRIPV

SEQ ID NO: 5247 - protein, 66 aa, Homo sapiens
MIKIGSQNKQKRKKSRKFLPACSLCMLLCNVILLLAPSRDGSPESELDHVNCFDHWSIHKHGTTEA

SEQ ID NO: 5248 - protein, 30 aa, Homo sapiens
MWCMLDITFLLGLWNFGICQAEGINVTTPQ

SEQ ID NO: 5249 - protein, 67 aa, Homo sapiens
MWRQKTLYFTFLLNVSFSLYFSFSLWYFFTPCPHPHPPTPTLALPNATKIVLIRTPGSPTNRSDTIN

SEQ ID NO: 5250 - protein, 52 aa, Homo sapiens
GATGMWRCRGYWAPGQNAIWWLALKMVLCCSCLGLGEFMRPSMSSLSGAVPL

SEQ ID NO: 5251 - protein, 22 aa, Homo sapiens
MLCSLSLSLLLFANSSTLNPKS

SEQ ID NO: 5252 - protein, 33 aa, Homo sapiens
MPVHSHTPVERLVYLTLFFSLLKKCHLTNSITS

SEQ ID NO: 5253 - protein, 9 aa, Homo sapiens
CCVLKIFGS

SEQ ID NO: 5254 - protein, 159 aa, Homo sapiens
MYTFACVHVCTCVCLCAYLSVCVHICMYMGPVIAARLLPRAFSARWPCLCSFCQPRGAEWPSSQPQWAQWGGPSSEGTRAAASPVFPHAVLRAPVHEPHSQEQSPRHLSHLGHPWPCVRSQSLEGFVHQAWDPGILPQSPPAWGQCGGWRGWRVARVAG

SEQ ID NO: 5255 - protein, 23 aa, Homo sapiens
MRNLEVMHSRSLGICDSHSVRCF

SEQ ID NO: 5256 - protein, 38 aa, Homo sapiens
MTGKMTVMMRIPSSIVTNTAMESEVPGFKTQVYRSLAV

SEQ ID NO: 5257 - protein, 53 aa, Homo sapiens
MRHHVAVLPLGSNVLKLLCLFFERNISREVPKSSLVISFNDAEILVKKLGSLP

SEQ ID NO: 5258 - protein, 21 aa, Homo sapiens
MITAIGIFTCILLSFISPMYI

SEQ ID NO: 5259 - protein, 37 aa, Homo sapiens
MYFPIICFRLFLFTEMIFSKIGTTKKLQMQTYVISLL

SEQ ID NO: 5260 - protein, 160 aa, Homo sapiens
ATRGGWLFRAIPASVEHGRVYVGNVAWMHVLAARELEQRAALMGGQVYFCYDGSPYRSYEDFNMEFLGPCGLRLVGARPLLPYWLLVFLAALNALLQWLLRPLVLYAPLLNPYTLAVANTTFTVSTDKAQRHFGYEPLFSWEDSRTRTILWVQAATGSAQ

SEQ ID NO: 5261 - protein, 14 aa, Homo sapiens
MAWTLLGRVVGHHP

SEQ ID NO: 5262 - protein, 1 aa, Homo sapiens
S

SEQ ID NO: 5263 - protein, 36 aa, Homo sapiens
MLIVYLKFQFNCASVFCLGILLWGTSRSLASSWSMS

SEQ ID NO: 5264 - protein, 12 aa, Homo sapiens
MILALIKMMTFA

SEQ ID NO: 5265 - protein, 41 aa, Homo sapiens
MHLCWAGALSFVFWANLILIYLFGTSESPQNILSSYFELGV

SEQ ID NO: 5266 - protein, 31 aa, Homo sapiens
MKAILCFLLLLMNPFPPFSFPSPIDQKCEGG

SEQ ID NO: 5267 - protein, 187 aa, Homo sapiens
  SITE (140): Xaa equals any amino acid
  SITE (141): Xaa equals any amino acid
  SITE (152): Xaa equals any amino acid
  SITE (175): Xaa equals any amino acid
  SITE (178): Xaa equals any amino acid
MHPLPRAWGLVVGSLAFTQGACLSHGGQPKVGRSPLGDWDKMPSFQRNVEASRKKKAVRPEESGVLHQRPVPSGQPLRWALGGCGVPGFHQGCVCLPRGASKRGKKSTGGWGQDVRLSGGHCGSPRKKVTRLKRKLGSSXXGQCLPGSLCAXSRGARTQFALKGADYNLIGRRFXNVXTWKNPWGYP

SEQ ID NO: 5268 - protein, 85 aa, Homo sapiens
MASYCGWIKTKTLAWLIRSAGFGSANLSSLLALSISLLFPSFVTQVSFLKMHHGLFPPPGTFFPPFPLTCQFLLSFISLLKCHCF

SEQ ID NO: 5269 - protein, 19 aa, Homo sapiens
  SITE (8): Xaa equals any amino acid
MIRQQYNXHFMSVAVSTFS

SEQ ID NO: 5270 - protein, 33 aa, Homo sapiens
MFSLSLILYFVSQIFPQFSWLNHFNCKGKIYIS

SEQ ID NO: 5271 - protein, 91 aa, Homo sapiens [sequence omitted]

SEQ ID NO: 5272 - protein, 148 aa, Homo sapiens
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 5273 - protein, 53 aa, Homo sapiens
MPARQCHVYTCMCVCTWVCVPVCVCGILVTFAIFSWLEVRGPSHTQRQELMQV

SEQ ID NO: 5274 - protein, 28 aa, Homo sapiens
MCLLNGCVCKIKMLTVATLLLSLPLGLL

SEQ ID NO: 5275 - protein, 31 aa, Homo sapiens
MTIPKDSLILFRLLAFIVYVLWFSTNIHYPQ

SEQ ID NO: 5276 - protein, 30 aa, Homo sapiens
MLCFLIWRLVMWVCSTCKKMHRAQDKCAFP

SEQ ID NO: 5277 - protein, 32 aa, Homo sapiens
MKPRVISTTIFFLLLFKSVCQSFKFFLSDCCH

SEQ ID NO: 5278 - protein, 36 aa, Homo sapiens
MLLMALLVTLLTSIQVGLPDAILSHPEITAVYIDLV

SEQ ID NO: 5279 - protein, 34 aa, Homo sapiens
MREGQLKAKRKPCMGRLCFWSYFFFFFFFTIHGI

SEQ ID NO: 5280 - protein, 30 aa, Homo sapiens
MLFPLFFILSIFSVHIVNSTLEMEKQSQRV

SEQ ID NO: 5281 - protein, 62 aa, Homo sapiens
MLQTHPLLSQLPAPGPRLVVSLAFLLYCIARYCPTCTMLRSLSTTCDSATGLIRVLRCVLPS

SEQ ID NO: 5282 - protein, 37 aa, Homo sapiens
ILGFPGCWGGSLALPVGLRLVGGGGGGSRCHGSRRPN

SEQ ID NO: 5283 - protein, 55 aa, Homo sapiens
MCVCVQACVHMCLCVHVCASVHVCECAYVHCVRECACGPCTHLSIHVSLHAHVSM

SEQ ID NO: 5284 - protein, 27 aa, Homo sapiens
MGRCTFVCRIEIFFSPYLIPPEFGDYL

SEQ ID NO: 5285 - protein, 132 aa, Homo sapiens [sequence omitted]

SEQ ID NO: 5286 - protein, 51 aa, Homo sapiens
IISLTPLWCLPSAIACSHILSFGFPPEIPNFPTRSYKAIQFSSASIRKLSF

SEQ ID NO: 5287 - protein, 17 aa, Homo sapiens
MLMPWGLGLGIWLCSLT

SEQ ID NO: 5288 - protein, 54 aa, Homo sapiens
  SITE (31): Xaa equals any amino acid
  SITE (40): Xaa equals any amino acid
  SITE (48): Xaa equals any amino acid
MCARKCRMLLVLQTVVCGTPKPLSFHDAFCXVITFPWRRXQPWWRALXWLCPSA

SEQ ID NO: 5289 - protein, 34 aa, Homo sapiens
MIVINKIKTIYLFLVMLQFTRKIQKILKKKICWN

SEQ ID NO: 5290 - protein, 34 aa, Homo sapiens
MLMNQVLTAPIGLVLLLLFALLTFPPSSSIRERN

SEQ ID NO: 5291 - protein, 27 aa, Homo sapiens
MTSYCPAGSVPRLSLPSTVRPLLGWLY

SEQ ID NO: 5292 - protein, 41 aa, Homo sapiens
MHWQIQLINWSSFLSLFSFLQISAQSPKYCLSGPIMCPCIL

SEQ ID NO: 5293 - protein, 1 aa, Homo sapiens
M

SEQ ID NO: 5294 - protein, 7 aa, Homo sapiens
MPLASAF

SEQ ID NO: 5295 - protein, 37 aa, Homo sapiens
MLFGSLCDLHSAFFLISSTACPTLSFLHSTPDVFQNL

SEQ ID NO: 5296 - protein, 5 aa, Homo sapiens
WLLKT

SEQ ID NO: 5297 - protein, 12 aa, Homo sapiens
MILFTMFILAGW

SEQ ID NO: 5298 - protein, 30 aa, Homo sapiens
  SITE (2): Xaa equals any amino acid
MXHGLLLISLQLLGPIITYTTISDPTTFLL

SEQ ID NO: 5299 - protein, 36 aa, Homo sapiens
LPSLLLFLNPFIFTILLLFPCGGFNTSIFFLNQLDS

SEQ ID NO: 5300 - protein, 4 aa, Homo sapiens
MLPL

SEQ ID NO: 5301 - protein, 37 aa, Homo sapiens
MGLLVPLTLLLQLSAGELSVVLQDSTDCMSELGLAWL

SEQ ID NO: 5302 - protein, 44 aa, Homo sapiens
TLLGPLEMFGRVWRRGTKVCTTRCLQSDWVSPSFKEAISVYPQN

SEQ ID NO: 5303 - protein, 152 aa, Homo sapiens
ISEHGLKPTTKAVPASDSSPSKPSSSSFLIPSFSSLALVEHFAQHGAWLIIKLPERTHIIITSSMKASTTSQAKLLCVSTQCSHILFCLWLAPFKENLFTYPSSTTLHSQHTNTVSHQQPSLSLCLHAVESKKELVGLIHLSPRAHKGATEN

SEQ ID NO: 5304 - protein, 2 aa, Homo sapiens
FT

SEQ ID NO: 5305 - protein, 47 aa, Homo sapiens [sequence omitted]

SEQ ID NO: 5306 - protein, 75 aa, Homo sapiens
MSLRPVTQTTFGDCGSVSSHRGKKPMNKQAQPLPPRSDDFMPQTANPHLPTDASVTAGEKPRNRGPDVETEPFRA

SEQ ID NO: 5307 - protein, 22 aa, Homo sapiens
GITFFFIYFGFCFSHEGLFSNI

SEQ ID NO: 5308 - protein, 50 aa, Homo sapiens
LLVDFDSDKRTQPIWVFFALIVWGFEVLARSWRGVCVQVCECMCNVCVQV

SEQ ID NO: 5309 - protein, 30 aa, Homo sapiens
MISDPLLLPLTFFLFISLSINFPVVEAQRW

SEQ ID NO: 5310 - protein, 12 aa, Homo sapiens
MPFTFFLFVNLL

SEQ ID NO: 5311 - protein, 39 aa, Homo sapiens
MSEAGWWAWLFVILHPFGMPDTFHNNFKKDKTTAEKCIE

SEQ ID NO: 5312 - protein, 38 aa, Homo sapiens
MFIALCSKVCVCVNAYVCVHTYVVFMPGMYTIWVHICN

SEQ ID NO: 5313 - protein, 31 aa, Homo sapiens
MRSLGLRCAFYLLCLLNPSALPDPAGRSPPL

SEQ ID NO: 5314 - protein, 30 aa, Homo sapiens
MLAGYFADLFMWLPHSVTCLCTSVCFCCGW

SEQ ID NO: 5315 - protein, 14 aa, Homo sapiens
MVIRLSNWAPTCVS

SEQ ID NO: 5316 - protein, 104 aa, Homo sapiens
MAPLPSSLLLLLTIYHGSSHLPSTMIVSFLRPHQEQVPAPCFLHSCSLLFFRMATANIVQMSKLPTPLCAPPTLNLLTLCSRCKLTCPFCHRGCLSPPSAVTLL

SEQ ID NO: 5317 - protein, 9 aa, Homo sapiens
QAQLIFSWG

SEQ ID NO: 5318 - protein, 30 aa, Homo sapiens
MGVLAVLLPVTGTWAWVRGGHVAPDTALRI

SEQ ID NO: 5319 - protein, 59 aa, Homo sapiens [sequence omitted]

SEQ ID NO: 5320 - protein, 32 aa, Homo sapiens
MGAGAFGYLALPCLVCLTYLLPTLSRNHSQMG

SEQ ID NO: 5321 - protein, 34 aa, Homo sapiens
MALEAGALYIGWILGQAFFFFFFSEVSLPKCGKV

SEQ ID NO: 5322 - protein, 15 aa, Homo sapiens
MHRSLSPCKIWLLFF

SEQ ID NO: 5323 - protein, 33 aa, Homo sapiens
MSLPHLLFSAFMSQAAWGLLFLGLLHSTNLRWA

SEQ ID NO: 5324 - protein, 50 aa, Homo sapiens
MWSLLHFCLLLASFLSCFELLASVCSLGRRFEEYSWFFPGSRGSGCAGVS

SEQ ID NO: 5325 - protein, 22 aa, Homo sapiens
MASLLMFLVPLNRIGRIPHLCR

SEQ ID NO: 5326 - protein, 1 aa, Homo sapiens
M

SEQ ID NO: 5327 - protein, 16 aa, Homo sapiens
SWCDGGCWCRLMYSFV

SEQ ID NO: 5328 - protein, 20 aa, Homo sapiens
MGSLLVFPRSSYALLHLIGV

SEQ ID NO: 5329 - protein, 34 aa, Homo sapiens
MIMPLCVVCIVLNPVLCIEEILQSIVLHKYWGLA

SEQ ID NO: 5330 - protein, 50 aa, Homo sapiens
MVTAVCQPVLTAPVFALLLPAVARSPSVGAALEPGKRNRRVKRGCGVPFM

SEQ ID NO: 5331 - protein, 34 aa, Homo sapiens
MDSTSDTPFPRWSLRLRSLVLVLIQGLSPVLSRV

SEQ ID NO: 5332 - protein, 39 aa, Homo sapiens
MFILLIMYLIWEGKAVSCYLLPPIKASVATVLTFNPWKF

SEQ ID NO: 5333 - protein, 181 aa, Homo sapiens
MNRRVCVLMLLVAWIGGFLHSLVQFLFIYQLPFCGPNVIDNFLCDLYPLLKLACTNTYVTGLSMIANGGAICTVTFFPLLLSYGVILPSLKTQSLEGKCKAFYTCASHITVITLFFVPCIFLFARPNSTFPIDKSMTVVLTCITPMLKPLIYALRNAEMKSAMRKLWSEKVSLAGKGLYPS

SEQ ID NO: 5334 - protein, 31 aa, Homo sapiens
MGWGLLCTFLYLAPQKTEGAAADLASTSPAP

SEQ ID NO: 5335 - protein, 30 aa, Homo sapiens
MLNLCITLLFLSVTLTNIHSNHSSYSNYLL

SEQ ID NO: 5336 - protein, 39 aa, Homo sapiens
MHPLLFYLVKLFLEARDTTCIIMSCPTPGIQEALKITCS

SEQ ID NO: 5337 - protein, 26 aa, Homo sapiens
MATMFTKITTSIVFGLSLALPISTRA

SEQ ID NO: 5338 - protein, 78 aa, Homo sapiens
MDSDFPTTKIMMLLASIPALLQGVVNILYRHRLGLSNFLPQCSLNSLKGSNVGPNLHTEKLRQKKSKQFVPCHQITYK

SEQ ID NO: 5339 - protein, 6 aa, Homo sapiens
MFIFFF

SEQ ID NO: 5340 - protein, 39 aa, Homo sapiens
MKSLLLAIAFQKLLGSPHPILQPHLFASLHPSPLIVQGS

SEQ ID NO: 5341 - protein, 32 aa, Homo sapiens
  SITE (6): Xaa equals any amino acid
PPPAVXSLPPLLLPSLLPPQGSGAASPSPTPW

SEQ ID NO: 5342 - protein, 28 aa, Homo sapiens
MSPNCHLLETRPSASLLLLGIPLLRGAS

SEQ ID NO: 5343 - protein, 33 aa, Homo sapiens
MLNVFAVPVYVLLIIFWERRAKKYTAENRQFML

SEQ ID NO: 5344 - protein, 38 aa, Homo sapiens
MNLKILTCFLVSYTFPSSRSAEPIMLKIIIIKKSGWRS

SEQ ID NO: 5345 - protein, 39 aa, Homo sapiens; identical to SEQ ID NO: 5311

SEQ ID NO: 5346 - protein, 62 aa, Homo sapiens
MFLQVSYLWTDVSAGQLLMWLCRWPTTVAGYFSQGTCLLEMYPLSSPFSSFCQRIAGVVEES

SEQ ID NO: 5347 - protein, 33 aa, Homo sapiens
MTAYLLVLQALTRLTAQTHHTGEHERVNESFII

SEQ ID NO: 5348 - protein, 29 aa, Homo sapiens
MPRPGSHLSWWRLWLAPRPPALLLRDSRT

SEQ ID NO: 5349 - protein, 9 aa, Homo sapiens
MVIIIVFNQ

SEQ ID NO: 5350 - protein, 37 aa, Homo sapiens
MCCYEALASWVMHFLVFALPRSLSHVSFSLGFYPTLK

SEQ ID NO: 5351 - protein, 13 aa, Homo sapiens
MLIFYILLCMVKG

SEQ ID NO: 5352 - protein, 17 aa, Homo sapiens
LFCPLLVIFQNFCSGDN

SEQ ID NO: 5353 - protein, 10 aa, Homo sapiens
MGVGLLNRII

SEQ ID NO: 5354 - protein, 66 aa, Homo sapiens
  SITE (36): Xaa equals any amino acid
  SITE (58): Xaa equals any amino acid
  SITE (63): Xaa equals any amino acid
MQLSSAVIAFSCCPVFMWSLVNSTRILSLLAKVLPXAERESPSKLTSVTPPSLTPHLXRATNXLFD

SEQ ID NO: 5355 - protein, 62 aa, Homo sapiens
MSGSQVVALFLLCVRISKVISVYCLESGLFCFTPTFTEKNFFSQATKHLVSGVKEDFIILEL

SEQ ID NO: 5356 - protein, 39 aa, Homo sapiens
MLAVFCFLSPNSLLFFIFWSRVYRFPPNRRSRPGIFLRG

SEQ ID NO: 5357 - protein, 34 aa, Homo sapiens
MLIIMAQLLQWFSCWSFLPLAALNCEWYRVTELT

SEQ ID NO: 5358 - protein, 63 aa, Homo sapiens
MRLPLRHSASLEASVSRVLHTPSGRDGPGTPCNPSGQMCHCPMKIKGHHSSSRRQNLNSNLSQ

SEQ ID NO: 5359 - protein, 36 aa, Homo sapiens
MLSCLRHWTWNLLVLRPLASMVTPAPHLVRRPSVSD

SEQ ID NO: 5360 - protein, 55 aa, Homo sapiens
MRENFTAKVWLAIPFLALGFLCVSEPRYTDFRSKESSSLPLGKTGRGMVLYQSHT

SEQ ID NO: 5361 - protein, 33 aa, Homo sapiens
MRVWRLAWFAWAWVGHGTSCTGVQSTLHIVTPS

SEQ ID NO: 5362 - protein, 46 aa, Homo sapiens
MKISFTFFILLLKNVLAARKFKMIDVAHIMFLCDRLLWIKSRQTMA

SEQ ID NO: 5363 - protein, 31 aa, Homo sapiens
MRLRDRRAGEGQRQLLLLRLLLRTSFWGVVF

SEQ ID NO: 5364 - protein, 66 aa, Homo sapiens
MLGVSASGSLQLLQSQRGLERGPAPRQPADTSSSMCESLVFTPTAPFSGGHCPKARHGRLTSPFYG

SEQ ID NO: 5365 - protein, 47 aa, Homo sapiens
MCGRQPMRLWVSFAVHCTRPVKAAPRNPTLLLCRLPWPESCHPTCRQ

SEQ ID NO: 5366 - protein, 49 aa, Homo sapiens
MTWPFFYSTFRVWALAPSVSALLTQCVKMKTEPSFPSSSVPQTFSPTQL

SEQ ID NO: 5367 - protein, 358 aa, Homo sapiens
MGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 5368 - protein, 37 aa, Homo sapiens; identical to SEQ ID NO: 4962

SEQ ID NO: 5369 - protein, 97 aa, Homo sapiens
MSISRLKIAKRFLQDIPQDQFLYIHLVLGGTSMGFHVLWLLVEFTQWRTLARGRKRGGSSLTGLNFTFCSPWMRAVIITIPGNSQRKRKGKRFGQDS

SEQ ID NO: 5370 - protein, 91 aa, Homo sapiens
MGTWIEMSSLWPCTWCTEPWRRSPCPPPCPRPSSHPPRERRLCSLAPSPSCLPAPHQKTASAPRRPTAASAASTAQGACPPSTASSKHSQQ

SEQ ID NO: 5371 - protein, 38 aa, Homo sapiens; identical to SEQ ID NO: 3312

SEQ ID NO: 5372 - protein, 58 aa, Homo sapiens
MRLPIRTQNYLQTCLGLGLASFLSSSGGVWQHSFFILILPGCGQHWSSVSPDGPPLCP

SEQ ID NO: 5373 - protein, 16 aa, Homo sapiens
MGDPPRASLDNALLAP

SEQ ID NO: 5374 - protein, 37 aa, Homo sapiens
MCVSFLKRIKALIWFFSFKKLLKAAQIGNTKKYGHES

SEQ ID NO: 5375 - protein, 80 aa, Homo sapiens
MNYYFFFKVTTLDFAIFQVLLVICQKAIMLITQSTLPPDGIGPQNSYLGELPSQNRMTFPHLLILLSFALSSSMENKNFS

SEQ ID NO: 5376 - protein, 26 aa, Homo sapiens
  SITE (16): Xaa equals any amino acid
MRSQDLTGFAVCWGQXIILLILDSQP

SEQ ID NO: 5377 - protein, 29 aa, Homo sapiens
MSGVPLRTGGWPAGLRGVSFHAGLPAAGQ

SEQ ID NO: 5378 - protein, 71 aa, Homo sapiens
MTEERGVWAVLLLRSLAPSLSCLTVCCSSWLLWCPLNSCVTCPGLSLSLLRQGAAGCFLTCTGMPQSTWPG

SEQ ID NO: 5379 - protein, 37 aa, Homo sapiens
MFYLMWWQFIQGVMFSQHLDTQGNFLFWGDSAPSGWR

SEQ ID NO: 5380 - protein, 67 aa, Homo sapiens
EQVEESLQDEDDNDVYILTKVSDILHSIFSSYKEKVLPWFEQLLPLIVNLICPHRPWARQTMGVMHL

SEQ ID NO: 5381 - protein, 30 aa, Homo sapiens
MHPHFFCLKIFTKVILLQVFYTGFICGQCR

SEQ ID NO: 5382 - protein, 124 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVL

SEQ ID NO: 5383 - protein, 6 aa, Homo sapiens
FTTGDF

SEQ ID NO: 5384 - protein, 33 aa, Homo sapiens
  SITE (13): Xaa equals any amino acid
  SITE (16): Xaa equals any amino acid
  SITE (30): Xaa equals any amino acid
SLGGWGGGQEGKXGGXKLGDSLRDFCFKPXVFL

SEQ ID NO: 5385 - protein, 15 aa, Homo sapiens
MPWWSRWVLWESCAS

SEQ ID NO: 5386 - protein, 42 aa, Homo sapiens
MCSLVVALYLIPPFHTDQLLPGSSPLLSVVKSVTNFWRSFNL

SEQ ID NO: 5387 - protein, 34 aa, Homo sapiens
MNIECFLILFLFSHQIVICHSSPLLFVLHFLLIV

SEQ ID NO: 5388 - protein, 92 aa, Homo sapiens [sequence omitted]

SEQ ID NO: 5389 - protein, 3 aa, Homo sapiens
MSI

SEQ ID NO: 5390 - protein, 13 aa, Homo sapiens
MKQKKIILLFNMA

SEQ ID NO: 5391 - protein, 33 aa, Homo sapiens
CVLSQFFHFPACFLMSAFGPIIVSQHHQHVDKK

SEQ ID NO: 5392 - protein, 14 aa, Homo sapiens
MEAIFTFTVLNGKI

SEQ ID NO: 5393 - protein, 5 aa, Homo sapiens
MWLAC

SEQ ID NO: 5394 - protein, 11 aa, Homo sapiens
MHVLPPHFCSA

SEQ ID NO: 5395 - protein, 10 aa, Homo sapiens
DRYFVLIQMQ

SEQ ID NO: 5396 - protein, 36 aa, Homo sapiens
MCHPLTGESGGVVGVNVLKIYVSCILFESAVFSQQL

SEQ ID NO: 5397 - protein, 47 aa, Homo sapiens
MFWMSLWVSFIIMLHNLYTGYHFRVLKGDTSYKEKDACFHFLKKKKK

SEQ ID NO: 5398 - protein, 33 aa, Homo sapiens
MCFCLKSINIWFHLHSNTWIGFILFLLAFWIQN

SEQ ID NO: 5399 - protein, 57 aa, Homo sapiens
MDSSAAVLGVLLKTLLLLWSCLLFPSQLVKPPSGATVFCNLQWAWRERASPALHACS

SEQ ID NO: 5400 - protein, 17 aa, Homo sapiens
MSYILDTFSLLLFLLYF

SEQ ID NO: 5401 - protein, 39 aa, Homo sapiens
EGLGASWLWHLTSWASTSCSQDPCGDERGAWKGLRPSTA

SEQ ID NO: 5402 - protein, 35 aa, Homo sapiens
MAQVLSWCAKETWLLLGIALRSSLSCPQPNWWAPC

SEQ ID NO: 5403 - protein, 28 aa, Homo sapiens
GNPKKLWRRMVLLLTRQTYLPLALLCGK

SEQ ID NO: 5404 - protein, 19 aa, Homo sapiens
MVTVVQTLLLLTQNRSGAM

SEQ ID NO: 5405 - protein, 72 aa, Homo sapiens
MPLGRLLPRLLFFLIVTYRLGVLGTESSQLLQYEETVHLFCHLDLFATHLLYFLYWKIFLLVLSYEFLFCFN

SEQ ID NO: 5406 - protein, 26 aa, Homo sapiens
LWWLYIVSVAIIQLCCSSANADIDNM

SEQ ID NO: 5407 - protein, 24 aa, Homo sapiens
VMEVLMTMVAIIITAMGMMALMTE

SEQ ID NO: 5408 - protein, 44 aa, Homo sapiens
MSCRCSGFLRRHLHSFLAFFAGEGFGPLSLREHRQRKPGRSRLQ

SEQ ID NO: 5409 - protein, 23 aa, Homo sapiens
MESGHCRLGKWSSLWWCCSCGLL

SEQ ID NO: 5410 - protein, 37 aa, Homo sapiens [sequence omitted]

SEQ ID NO: 5411 - protein, 33 aa, Homo sapiens
  SITE (3): Xaa equals any amino acid
  SITE (5): Xaa equals any amino acid
  SITE (10): Xaa equals any amino acid
MSXSXGTSVXFLRTRFSLCICGRNTPEVMLCYS

SEQ ID NO: 5412 - protein, 30 aa, Homo sapiens
MFWCEFTASFLLFLNAISGLHINSITHPWE

SEQ ID NO: 5413 - protein, 17 aa, Homo sapiens
MSSLLLIIILALSLAYE

SEQ ID NO: 5414 - protein, 6 aa, Homo sapiens
LPGPCL

SEQ ID NO: 5415 - protein, 66 aa, Homo sapiens
MTLVGKTRLSRPGQGAFGCFCCPWLCSALWEAPGRPNVQDHRGESELDRKRTTACVGPLPTIKIAP

SEQ ID NO: 5416 - protein, 180 aa, Homo sapiens
MCYGRCARCIGHSLVWLAILCIVANILLYFPNGETKYASENHLSRFVWFFSGIVGGGLLVFLPAFVFIGLEKDDCCGCCGHEDCGKRCAMFSSVLPAAIGVAGSGYCVSWQPWAWRKDHYVLILRASGTTPLPTPMDSTFWIPPHGPSALNPHMLLNGISLCFLSFWPSVELNSSCVSFK

SEQ ID NO: 5417 - protein, 41 aa, Homo sapiens
MCLIQGMYLITHFCTCTLVWFCNLQFSNQSFIVTFSLPVSL

SEQ ID NO: 5418 - protein, 34 aa, Homo sapiens
MSGLCESRREVFQIMHMDVELLRLLELWMAVLFR

SEQ ID NO: 5419 - protein, 152 aa, Homo sapiens
MEFLGPCGLRLVESRLLVPYWLLVLLAALNALLQWLLRPLFLYAPLLNPYTLAVASTTFTVSTDKAHATSATYPCSLGRTAGPAPSAGCRPWRAQPGDVELGPGARCVARPSIQVQGPLALGAEGLVLHQLACLAAPRASKPRAASLHPHAS

SEQ ID NO: 5420 - protein, 67 aa, Homo sapiens
MTFLITIFRQYLQWSCAPLLLPVLPQKGTSSGDSTQNLFILSEESIIGICVYPDVESYLKCTREIPI

SEQ ID NO: 5421 - protein, 46 aa, Homo sapiens
MKGHQSVFWDFFFFFVFGGREKETRQKRNCRMRKERGEKSSRRNLK

SEQ ID NO: 5422 - protein, 29 aa, Homo sapiens
  SITE (17): Xaa equals any amino acid
MMNTLSGSGGCWSHCAXHHWHCHPHEWQV

SEQ ID NO: 5423 - protein, 51 aa, Homo sapiens
  SITE (7): Xaa equals any amino acid
  SITE (9): Xaa equals any amino acid
  SITE (13): Xaa equals any amino acid
MIIYYCXLXSSSXFYATVKLMNRVVFGNGNTFVTDLYTVYSIGKMGGGFLI

SEQ ID NO: 5424 - protein, 114 aa, Homo sapiens
LGRLLLRGPRCLLSPATPTLVPPVRGMKKGFRAAFRFQKELERWRLLRCPPPPVRRSEKPNWDYHAEIQAFGHRLQETFSLDLLKTAFVNTCYIKSEEANAKPWNRERSCSSES

SEQ ID NO: 5425 - protein, 37 aa, Homo sapiens
MPLRSFQQVILIAVGVFLSLAALAGGCYFLVLRYKGW

SEQ ID NO: 5426 - protein, 37 aa, Homo sapiens
MGLSAQQGACFLLSLCLPLCLLVISLCQINKFFKNKN

SEQ ID NO: 5427 - protein, 206 aa, Homo sapiens
MTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPIFPQLYFHMIHQRRKILSHTEEHKKFE

SEQ ID NO: 5428 - protein, 35 aa, Homo sapiens
MSGTTSGLQLCLVIMMNCVCVTLKDSVCQVKKNDV

SEQ ID NO: 5429 - protein, 25 aa, Homo sapiens
MELSRLWHVGFVFLFSFDYVRAISL

SEQ ID NO: 5430 - protein, 37 aa, Homo sapiens
MFCVSLCVCVCVCVRVLTWCSDAQHHNRPPFSSTVGE

SEQ ID NO: 5431 - protein, 26 aa, Homo sapiens
MLPECLLCCVVVGMLLHLSVPQFPQL

SEQ ID NO: 5432 - protein, 211 aa, Homo sapiens
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRAPRSYPKSNSSKEYV

SEQ ID NO: 5433 - protein, 19 aa, Homo sapiens
MSFTAHSGWWVSLLFWVLD

SEQ ID NO: 5434 - protein, 63 aa, Homo sapiens [sequence omitted]

SEQ ID NO: 5435 - protein, 27 aa, Homo sapiens
GPGQRPPGDAAAVQSRPRPGDAGGAGE

SEQ ID NO: 5436 - protein, 216 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 5437 - protein, 14 aa, Homo sapiens
MCAAFLSFGLIHLI

SEQ ID NO: 5438 - protein, 51 aa, Homo sapiens
MRLGPNRMRGRVLHAWLPLLLLLLLLQCTHHSSQLLLLLLAYSLRNLSLVL

SEQ ID NO: 5439 - protein, 21 aa, Homo sapiens
MKPKFPAFAGFPIYFFVDFAS

SEQ ID NO: 5440 - protein, 52 aa, Homo sapiens
MCACVCMHVCACAHVCVRRGCFPMAQSLWGSPKLQGQPWGAPSLESEDHSCL

SEQ ID NO: 5441 - protein, 38 aa, Homo sapiens
MFSKKLFYIQSSLFSLLYFYFVEAFSPQIIYYIIFGLI

SEQ ID NO: 5442 - protein, 23 aa, Homo sapiens
MSLGPSPMCILWLLDPLQKSNTK

SEQ ID NO: 5443 - protein, 33 aa, Homo sapiens
MFLAMLAIISCAVCFSCAEAKTYWAYVPKPPAV

SEQ ID NO: 5444 - protein, 31 aa, Homo sapiens
MALFRIFLVAWFVAFLSVRKLNPILRALEEL

SEQ ID NO: 5445 - protein, 43 aa, Homo sapiens
SCHLMSGMYPPTPSLQATRNTATHNLMSPGEHHCLVSSGIPRH

SEQ ID NO: 5446 - protein, 76 aa, Homo sapiens [sequence omitted]

SEQ ID NO: 5447 - protein, 44 aa, Homo sapiens
MTSACLAWTAVSLPPAVTHRAPLCLPPVPCRLVRRPGCAASDLP

SEQ ID NO: 5448 - protein, 64 aa, Homo sapiens
PCFGPVLEWLAAGPGCPPSARGRRLWHRSPASEATPRLLPTVGAPRGPALRGAAAKKPQSGGAG

SEQ ID NO: 5449 - protein, 59 aa, Homo sapiens
MLTQPLLLSLLLYCACRLVLLPVSLKTQPEVGWLCVHNFNFTCGAESLCCISLCKSTIC

SEQ ID NO: 5450 - protein, 50 aa, Homo sapiens [sequence omitted]

SEQ ID NO: 5451 - protein, 66 aa, Homo sapiens
FLLKHGHPPLMATAEPLGKEPFGIQNSQVAAQCGIWSMTTKAFSQHLLKESGVFYTLLMGTVHEHI

SEQ ID NO: 5452 - protein, 67 aa, Homo sapiens
MSSVTVEIFVWSACCISSTSFHPFLAFIRLKFIIIWMSFRIGTVGVRSYCHLLTKDFAGGIMCGCYL

SEQ ID NO: 5453 - protein, 85 aa, Homo sapiens
MEKLVLVLANLFGRKYIPAKFQNANLSFSQSKVILAELPEDFKAALYEYNLAVMKDFASFLLIASKSVNMKKEHQLPLVKNQIHR

SEQ ID NO: 5454 - protein, 15 aa, Homo sapiens
MKLEVAPVFCWSCCA

SEQ ID NO: 5455 - protein, 8 aa, Homo sapiens
YPAFIGNF

SEQ ID NO: 5456 - protein, 26 aa, Homo sapiens
MIRYLLMCPLYIQLLFLTLLFVLSLP

SEQ ID NO: 5457 - protein, 42 aa, Homo sapiens
ITGVSHRTWPSVVFLIIWKKIKKKKKKKKKKKKKKKKKKKKK

SEQ ID NO: 5458 - protein, 23 aa, Homo sapiens
LVHMAYVTFGKSLAFSESRFPRL

SEQ ID NO: 5459 - protein, 12 aa, Homo sapiens
YLVFLFQYSNIL

SEQ ID NO: 5460 - protein, 32 aa, Homo sapiens
MYSAFHNCLCLALHVLTFLYDVGSSVNLQRKI

SEQ ID NO: 5461 - protein, 14 aa, Homo sapiens
MLLMFFTFWTRERL

SEQ ID NO: 5462 - protein, 70 aa, Homo sapiens
MVQKWRLLLNLLTLPHRSKLLFKMCLTPYFVFRVLDSYLKLGSFGSCLIFCSALRLSLPSTYSGFVCQFF

SEQ ID NO: 5463 - protein, 53 aa, Homo sapiens
MELTIGTFRIMMINWLVFSQHCQLFLRSLLLPLLLCTHHVCMECARRGRGSGR

SEQ ID NO: 5464 - protein, 18 aa, Homo sapiens
  SITE (9): Xaa equals any amino acid
MILLLLRLXCILKQLAFF

SEQ ID NO: 5465 - protein, 61 aa, Homo sapiens
MLCAMLACGGLCNALTCMEEARLRAEMWPEPSLYRSFNLELSRCHFLPLCLLVVSDIYSKQ

SEQ ID NO: 5466 - protein, 28 aa, Homo sapiens
MLLDAPAIIFLLVAFPNYFHKNYFSYYM

SEQ ID NO: 5467 - protein, 26 aa, Homo sapiens
MAYFYLLGVLQVLPSLHHYMSSEVLF

SEQ ID NO: 5468 - protein, 12 aa, Homo sapiens
MLCLFLLASITI

SEQ ID NO: 5469 - protein, 37 aa, Homo sapiens
MKILLLCLCLILLRVRSCRRKAARAALGMEAADAVTD

SEQ ID NO: 5470 - protein, 28 aa, Homo sapiens
MILMMVIRFLLVPLLIPTTDLHATANSS

SEQ ID NO: 5471 - protein, 16 aa, Homo sapiens
MYFFCFCGFACSGYFL

SEQ ID NO: 5472 - protein, 32 aa, Homo sapiens
MRSCRLARGQLELCWLLIIILKGSEICDGIRF

SEQ ID NO: 5473 - protein, 29 aa, Homo sapiens
MHMEYLLVLLNLTSHPECIDRKSMSYLKL

SEQ ID NO: 5474 - protein, 32 aa, Homo sapiens
MHLIWLCVTGLFISATEIHAVCTYNRYIVSAY

SEQ ID NO: 5475 - protein, 91 aa, Homo sapiens
MVQTALAWWPSSHQPTSGNVSVYCWPYSVTNPAAPCISWLPTPTSPWTSPVEPGSDPDSVPAFQEKLSHFLQASHRSLPRMWAACSSNSTS

SEQ ID NO: 5476 - protein, 40 aa, Homo sapiens
MFVTGKIVTWVNFISSNSFLVLILSMLPKSSLISMNHCFM

SEQ ID NO: 5477 - protein, 44 aa, Homo sapiens
MFLTVFLFVILFMYAFIFVITFFFTLDLLLSFLSPSFLGGRQGH

SEQ ID NO: 5478 - protein, 21 aa, Homo sapiens
MNVRYWDRDPNLKQQPVPVVT

SEQ ID NO: 5479 - protein, 46 aa, Homo sapiens
NLFVSVYDSFFSLVQSSASPALSSTLQSPFRESISRNETRQSCSAP

SEQ ID NO: 5480 - protein, 36 aa, Homo sapiens
MNFYVTLYRVFPLAFSLSLTLSLNFLRLHNSIMKFT

SEQ ID NO: 5481 - protein, 47 aa, Homo sapiens
MKYQSEWKDVILLLHVPSPSFHGGTALPILSFVYAWPILRSSGDKPE

SEQ ID NO: 5482 - protein, 37 aa, Homo sapiens
LGLWALLAGLTLPVRAEPGWQEGRTVYLLLRAPKALL

SEQ ID NO: 5483 - protein, 31 aa, Homo sapiens
MPACFVSFSVFFCATVPCAGSMPASWHHLQC

SEQ ID NO: 5484 - protein, 38 aa, Homo sapiens
MIGTLHLSLSVILASVLFAYQNAVCFCQRITIKPLRPN

SEQ ID NO: 5485 - protein, 310 aa, Homo sapiens
  SITE (38): Xaa equals any amino acid
  SITE (40): Xaa equals any amino acid
  SITE (127): Xaa equals any amino acid
MVYKTLFALCILTAGWRVQSLPTSAPLSVSLPTNIVPXTXIWTSSPQNTDADTASPSNGTHNNSVLPVTASAPTSLLPKNISIESREEEITSPGSNWEGTNTDPSPSGFSSTSGGVHLTTTLEEHSXGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 5486 - protein, 25 aa, Homo sapiens
MVVFVFLPLLWLLQLPLSGTRRTIL

SEQ ID NO: 5487 - protein, 29 aa, Homo sapiens
MLCVLSSFLLIFLFLICVQFCAALLALLL

SEQ ID NO: 5488 - protein, 31 aa, Homo sapiens
EWTLRYFRCVLFSIAAVFVTVLVMVHVHILL

SEQ ID NO: 5489 - protein, 31 aa, Homo sapiens; identical to SEQ ID NO: 5488

SEQ ID NO: 5490 - protein, 36 aa, Homo sapiens
MQLSLPKIFFYLCFCLQLLPLEVSLSFKFREPCLWH

SEQ ID NO: 5491 - protein, 31 aa, Homo sapiens
MVHPLVALWPWASFFNFLIYTVNSTYIIGLV

SEQ ID NO: 5492 - protein, 72 aa, Homo sapiens
MLLSIAIWVAWITLLMLPDFDRSGMTPSSAPPWLPMAGCSCWLMLVPSFGCSQSNETPWIILLRMLSVNLNS

SEQ ID NO: 5493 - protein, 58 aa, Homo sapiens
MSHRAQPTFTSKVYVMVVIFSLLEYIKWLIWGGKLILNINGGEKGTVFTLKCKSEHTK

SEQ ID NO: 5494 - protein, 49 aa, Homo sapiens
MTTCKELCPWNFVWFFFVFDLLGRMSNIYKSRLNSEMNIQISIIQRLLL

SEQ ID NO: 5495 - protein, 35 aa, Homo sapiens
MITCSHGQIFFSPCSSWPETRETRVKSYLPLPVMP

SEQ ID NO: 5496 - protein, 36 aa, Homo sapiens
MALTLPSQWVFLVFILDDLYAHLSLSRNFCWKHLLF

SEQ ID NO: 5497 - protein, 34 aa, Homo sapiens
MIWNRSLLLAIYFLCGLRQVTYFSESPFLNLFVN

SEQ ID NO: 5498 - protein, 18 aa, Homo sapiens
MFNPLSPHPDLFLLSHLI

SEQ ID NO: 5499 - protein, 10 aa, Homo sapiens
LEFFFFFFVL

SEQ ID NO: 5500 - protein, 31 aa, Homo sapiens
MFLDFCWQACSSICMAPSPHLHFSAQMLPSP

SEQ ID NO: 5501 - protein, 9 aa, Homo sapiens
NLQFSMTQL

SEQ ID NO: 5502 - protein, 3 aa, Homo sapiens
MSV

SEQ ID NO: 5503 - protein, 26 aa, Homo sapiens
MLAIITFLKAHLGTHNMGQDQRVETS

SEQ ID NO: 5504 - protein, 6 aa, Homo sapiens
MCFLCV

SEQ ID NO: 5505 - protein, 25 aa, Homo sapiens
MAISLVTLLFPLLSSQFNLPTEYQA

SEQ ID NO: 5506 - protein, 67 aa, Homo sapiens
PPNLCLTFLLPFVLLRLSVLGNTVFLRVCGGSYPSSFRTRDLLDWSGPQTDPCSLTTGYPGTCVPSL

SEQ ID NO: 5507 - protein, 38 aa, Homo sapiens
MLVSPRRVYFLDLTCFVAFLLLVQCSVLTVCPQVTEEE

SEQ ID NO: 5508 - protein, 34 aa, Homo sapiens
MNITSHQPPHHNFMLLLDIIFVLAWILMLLTNIS

SEQ ID NO: 5509 - protein, 61 aa, Homo sapiens [sequence omitted]

SEQ ID NO: 5510 - protein, 24 aa, Homo sapiens
MWLWTSPWRSGLCWILLRGTSTEM

SEQ ID NO: 5511 - protein, 87 aa, Homo sapiens
MYIAHHLLTLGHQFRLRLAPILCDGTATFVDLVPGFRRLGTECFLAQMRAQKVNFWKDYQVLGTFQIWTMKRIILQQVKQSGRYCTN

SEQ ID NO: 5512 - protein, 31 aa, Homo sapiens
MFRPWHGLLPGSRLVPWGLVRLVGAPNPCAH

SEQ ID NO: 5513 - protein, 12 aa, Homo sapiens
MFIACLLQSLCI

SEQ ID NO: 5514 - protein, 28 aa, Homo sapiens
MVFQTFYCISLVLFAHEVSLLCVCVYVY

SEQ ID NO: 5515 - protein, 18 aa, Homo sapiens
MLCFSFLCLSLLLVSAQG

SEQ ID NO: 5516 - protein, 18 aa, Homo sapiens
MLCFSFLCLSLLLVSAQG

SEQ ID NO: 5517 - protein, 23 aa, Homo sapiens
MSSICPIFVLLQMISFMTLIALE

SEQ ID NO: 5518 - protein, 67 aa, Homo sapiens
MHTYILVCICIHIYLCVYAYIYTCMCMYICIHIYLYVYVHMHTYIYTHTYTHAYFFSQLGKGRICRL

SEQ ID NO: 5519 - protein, 112 aa, Homo sapiens
MALGVPISVYLLFNAMTALTEEAAVTVTPPITAQQGNWTVNKTEADNIEGPIALKFSHLCLEDHNSYCINGACAFHHELEKAICRCFTGYTGERCLKLKSPYNVCSGERRPL

SEQ ID NO: 5520 - protein, 34 aa, Homo sapiens
VAFFTMPTVVLVSMFDFFFSGISSSFVNIRLQFF

SEQ ID NO: 5521 - protein, 36 aa, Homo sapiens [sequence omitted]

SEQ ID NO: 5522 - protein, 34 aa, Homo sapiens
MNAVTLPILFTFVSPVPIVVHGAEWPFNKYLLNK

SEQ ID NO: 5523 - protein, 45 aa, Homo sapiens
MQEILPPGSHTGFSGLHLPFIGFTFTTERYVWIYHSPGRHFPCGR

SEQ ID NO: 5524 - protein, 65 aa, Homo sapiens
MIWLSVCLLLVYKNACDFCTLILYPETLLKLLISLRRFWAETMGFSRYTIMSSANRDNLTSSFPN

SEQ ID NO: 5525 - protein, 37 aa, Homo sapiens
MKSCQDSDSPFPVILLMISPNTLQATVTTKNTVSAGL

SEQ ID NO: 5526 - protein, 43 aa, Homo sapiens
MYLFRWFFVVTYFIVLISCFCITVPIANKSLGQFAFLKKKKKK

SEQ ID NO: 5527 - protein, 11 aa, Homo sapiens
MGLLDWLLGNS

SEQ ID NO: 5528 - protein, 32 aa, Homo sapiens
MGNLLLLQLMLLKLLTVIPFPWLFFGEKIICS

SEQ ID NO: 5529 - protein, 3 aa, Homo sapiens
MFP

SEQ ID NO: 5530 - protein, 25 aa, Homo sapiens
GRHTWSLLLAALACLVPLLHWNIRR

SEQ ID NO: 5531 - protein, 10 aa, Homo sapiens
MQAGWLGQVG

SEQ ID NO: 5532 - protein, 49 aa, Homo sapiens
MLTLCVCVCVCVCTRACACLLHGILFCEIPLQSCQNLPPCPSHTVGSAL

SEQ ID NO: 5533 - protein, 54 aa, Homo sapiens
MLQYKALSMSGKSLLQKRLQITLTCAWLCWMVYSVSFFFMGETAHRAHQQVLQN

SEQ ID NO: 5534 - protein, 39 aa, Homo sapiens
MLGDSSLALVWLGLCLPPWGKPGTPLLPALPRPLSLGGW

SEQ ID NO: 5535 - protein, 31 aa, Homo sapiens
DAWGWGELLLIVKNSLGASDLMPSILSGFSL

SEQ ID NO: 5536 - protein, 31 aa, Homo sapiens
MYNLLYFPLCILLWVFCGSQDSSLRFISHES

SEQ ID NO: 5537 - protein, 38 aa, Homo sapiens
MPSARHCIAIISFNLLLILWVGIFILISETRKLRVREN

SEQ ID NO: 5538 - protein, 40 aa, Homo sapiens
MSHFHSQNQMYLFSAFLWELLLSAGILKPNIHFQFFQLLS

SEQ ID NO: 5539 - protein, 18 aa, Homo sapiens
MQKVTTLRHIENCLAGKC

SEQ ID NO: 5540 - protein, 88 aa, Homo sapiens [sequence omitted]

SEQ ID NO: 5541 - protein, 12 aa, Homo sapiens
HTFLWFLYVCSN

SEQ ID NO: 5542 - protein, 55 aa, Homo sapiens
MSGWQAWYLARALAVGVLMGCTDHTAYVLAIPSCSPARSLKHTSLAFLFFCSFFN

SEQ ID NO: 5543 - protein, 80 aa, Homo sapiens; identical to SEQ ID NO: 3474

SEQ ID NO: 5544 - protein, 24 aa, Homo sapiens
MVVLLEIFLLLAYVLWNYTCITND

SEQ ID NO: 5545 - protein, 31 aa, Homo sapiens
MLATQHTLEHWLFTLLMVWLPSIKSYHTANR

SEQ ID NO: 5546 - protein, 39 aa, Homo sapiens
MHLLFLFVPMYQCRVALFSSTVFIAAFLSINLSHCIFYK

SEQ ID NO: 5547 - protein, 40 aa, Homo sapiens
RIRARCLAVAACSRGRVGLSRGWCCRCSRCRQSGRRHGFW

SEQ ID NO: 5548 - protein, 44 aa, Homo sapiens
MAGLSLPTLFFFNMILDCLGPWENSIYILKSVFTFLQIKRPLGF

SEQ ID NO: 5549 - protein, 2 aa, Homo sapiens
ML

SEQ ID NO: 5550 - protein, 31 aa, Homo sapiens
MFLYVSVVFLILLLNSSQLCKYTAIYLYTYF

SEQ ID NO: 5551 - protein, 31 aa, Homo sapiens
MSIPHLWCHFFTFLLPCIKRQKIHIKLCHVF

SEQ ID NO: 5552 - protein, 36 aa, Homo sapiens
MACLELLILVSFLTSVIQTQPPRELDPSLFSVFSLA

SEQ ID NO: 5553 - protein, 36 aa, Homo sapiens; identical to SEQ ID NO: 5552

SEQ ID NO: 5554 - protein, 4 aa, Homo sapiens
MHAL

SEQ ID NO: 5555 - protein, 12 aa, Homo sapiens
MIHRLQKLYELR

SEQ ID NO: 5556 - protein, 28 aa, Homo sapiens
MYFICNLLLLLGHIYVYIWMSVYIYMYK

SEQ ID NO: 5557 - protein, 74 aa, Homo sapiens
MKDFVVTGKRNPDCVFSLQGCPQRSYSLWLLLWVIGDNVLKKVLFFCLLKNRILKVISQKKWPSVKGLFPMCSA

SEQ ID NO: 5558 - protein, 36 aa, Homo sapiens
MVFPFLSFASSCTLSMVFSDSIFLNSLFIFLGNFLL

SEQ ID NO: 5559 - protein, 73 aa, Homo sapiens
MLHILFMGLRVNLNHETFLIICCEIYQAWMISVFLVVCCFFKEVIQVPLLSCQHTKLLKKLTISFRSNSQPVE

SEQ ID NO: 5560 - protein, 9 aa, Homo sapiens
SCSIRYDLF

SEQ ID NO: 5561 - protein, 34 aa, Homo sapiens
MFITPLSWSLLIWVLLGFLLLFLNYSRLLYILDF

SEQ ID NO: 5562 - protein, 51 aa, Homo sapiens
HFSKFTLSLLASGRYIYSHMVFTFFSIVLEALIMLVEQLTSRVFFPACHTC

SEQ ID NO: 5563 - protein, 30 aa, Homo sapiens
MFSIFFFMKTLFFPLIKHILLWCLFFLLAV

SEQ ID NO: 5564 - protein, 108 aa, Homo sapiens
ITYQDVGCPGVLPDSSLLVPIPNVLLSFFAFHNIKETTTLLPNSILCLLFHIKWELCLLRSAPPINYMCPRIIQARDTRWENISKKKSPLKASNLSEKVFYHTLTPYI

SEQ ID NO: 5565 - protein, 10 aa, Homo sapiens
MLLFLVSHLA

SEQ ID NO: 5566 - protein, 11 aa, Homo sapiens
VVIMLVIPLIV

SEQ ID NO: 5567 - protein, 26 aa, Homo sapiens
MSCKTLLKMVWFFFCFCLVFFFHENK

SEQ ID NO: 5568 - protein, 187 aa, Homo sapiens
NGVVHDVVLVLILGACIVVHAVTVTSLGNLFGGAGQTQQSWVEVLDVAGHGFNVVPLGVHSDEDRLHWRQTRLCFQLPHHLHQLLQLVWADVRAVSEAKVHQHPLAPEVSLAASPASVIQQVEVALAHSCLAQGFCSLLLLQPLLLSPQGQPGPTESSPEQACDQQPGSKPRALGLALPTCLCRALP

SEQ ID NO: 5569 - protein, 71 aa, Homo sapiens
GRLIWGALWPVPDCGCTAPEGQDQPPSLVCCHGCRPGSHAEVWQGCSRGQDYAGFSVGSGAGAPSLEEPRS

SEQ ID NO: 5570 - protein, 37 aa, Homo sapiens
MPSRTPPSSLLWLGWTWATTWMWLPCPSPCWSACAGG

SEQ ID NO: 5571 - protein, 33 aa, Homo sapiens
MPVVSVHRPVTVSTCVPSPGHPVKRAHFLQSGI

SEQ ID NO: 5572 - protein, 20 aa, Homo sapiens
MFFRLLTYLLFLLPTSADNS

SEQ ID NO: 5573 - protein, 38 aa, Homo sapiens
MWLILLAIPGVAAHAWLVWVHRGSHGWAQQRGPSGEGF

SEQ ID NO: 5574 - protein, 63 aa, Homo sapiens
MCFYHHRETAFKSTYLYGTAVTRHIHPSRTDACDPEARRSFVLGDVHIGIYLTAKEPFIYIYI

SEQ ID NO: 5575 - protein, 35 aa, Homo sapiens
MRLLTSGWLLWARTGPSWGARSRISLIWRCMACCV

SEQ ID NO: 5576 - protein, 44 aa, Homo sapiens
VLAAFVLGAALAAGLGLVCAHSAPHAPGPPARASPSGPQPRRSQ

SEQ ID NO: 5577 - protein, 65 aa, Homo sapiens
LPAGTWQPGRGAGAVGAAGGVDSSSEGRTRLAGGEDGVPAAQSPQGSPLRATKQDRAALVPGPSG

SEQ ID NO: 5578 - protein, 6 aa, Homo sapiens
MNTYLR

SEQ ID NO: 5579 - protein, 24 aa, Homo sapiens
MVLAKAQLLIFWLVILNQLQARYF

SEQ ID NO: 5580 - protein, 36 aa, Homo sapiens
MFLNLKFLLLLHFCESHLKFFREGILSFVQRCLYFY

SEQ ID NO: 5581 - protein, 13 aa, Homo sapiens
MDFQPFFPICSCF

SEQ ID NO: 5582 - protein, 39 aa, Homo sapiens
MSTPSVLLFYSSFLLIFILWDERLGSIEKNINHQFVTYP

SEQ ID NO: 5583 - protein, 39 aa, Homo sapiens
MLHPGLCCQAHFFLHLPPLTSAAPSCMPQFFLKSLDAFS

SEQ ID NO: 5584 - protein, 41 aa, Homo sapiens
QPLVSFLWLILSLSSTLRRQNGETKKATLKVFILSGYLAFF

SEQ ID NO: 5585 - protein, 34 aa, Homo sapiens
FLKALQVIFFLLFKNYNFYFLYCSFKTSCYSICR

SEQ ID NO: 5586 - protein, 59 aa, Homo sapiens
  SITE (24): Xaa equals any amino acid
MLSIDLLLFSLLFLLLCGYFLLIXRILLVNMLHIHIIWCPVFPFTYYTFHISTLSDISA

SEQ ID NO: 5587 - protein, 12 aa, Homo sapiens
MFSHPPPQPLLN

SEQ ID NO: 5588 - protein, 24 aa, Homo sapiens
MFIMAFILLISFYMLILISSSMSK

SEQ ID NO: 5589 - protein, 130 aa, Homo sapiens
MYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 5590 - protein, 130 aa, Homo sapiens; identical to SEQ ID NO: 5589

SEQ ID NO: 5591 - protein, 97 aa, Homo sapiens
EFGFFFSLFLVISLFVWKESYFSLDITPEFPSDALLRVRAVADSLKFSSALPYLPFILGIGKCCKGPDGKYFRLYGLVSVANIQLCQCTLKAAIDNM

SEQ ID NO: 5592 - protein, 30 aa, Homo sapiens
MVCCVVFFFFWKESLLFIRFLKDSKTKKGL

SEQ ID NO: 5593 - protein, 36 aa, Homo sapiens
MRLKLLEYRTILLIVFLHSFSAWQRDGRGPDTDYLG

SEQ ID NO: 5594 - protein, 25 aa, Homo sapiens
MIHLKSVTSLMLLAINLGNMKQSCS

SEQ ID NO: 5595 - protein, 59 aa, Homo sapiens
EILLLSFLFIYLRFSLSFSSDLSPSICLSSFIFLSSPFLPASATSLVSWLLTFLRHRLL

SEQ ID NO: 5596 - protein, 49 aa, Homo sapiens
MLLRDIEVYFLGQVGIFYPCSFFILATHICSLAHPTAPPTRPRWILPQC

SEQ ID NO: 5597 - protein, 31 aa, Homo sapiens
MPTSQKQMPLFLCQNLMVLWLLLNPVNLEPI

SEQ ID NO: 5598 - protein, 36 aa, Homo sapiens
MHHQAGHFKLSSRNEFLCFLALLFAWGWERVVSSNC

SEQ ID NO: 5599 - protein, 39 aa, Homo sapiens
MPSLLHIIVRPFLLLWSPTISFVLYPGERGRVNGTGWFL

SEQ ID NO: 5600 - protein, 4 aa, Homo sapiens
MWRW

SEQ ID NO: 5601 - protein, 35 aa, Homo sapiens
MILSLVLSYNLFLVQLILCTITAEMSNWDRLASKA

SEQ ID NO: 5602 - protein, 51 aa, Homo sapiens [sequence omitted]

SEQ ID NO: 5603 - protein, 48 aa, Homo sapiens
  SITE (36): Xaa equals any amino acid
MFLLSLLLKMIHFIANSFLSSISSFLSVCHSDLCYXSYLVAILKVFKM

SEQ ID NO: 5604 - protein, 21 aa, Homo sapiens
MLRTDLIKLSWYLRHFLKGCI

SEQ ID NO: 5605 - protein, 30 aa, Homo sapiens
MIKAVLTFLKIHCLGWAGNSFEVTLIRLQC

SEQ ID NO: 5606 - protein, 46 aa, Homo sapiens
MSIIPCRPQPRAGRCYSLCFMLLLWPLFLPSSELCRVYCRQSEVSF

SEQ ID NO: 5607 - protein, 24 aa, Homo sapiens
CTTVVLFLLIELKQLYGAKVTGYS

SEQ ID NO: 5608 - protein, 45 aa, Homo sapiens
FNFDVILLLVIFAFVSCTFVSYPIMCIIYIYMHIHTHIYIYNRYI

SEQ ID NO: 5609 - protein, 45 aa, Homo sapiens; identical to SEQ ID NO: 5608

SEQ ID NO: 5610 - protein, 38 aa, Homo sapiens; identical to SEQ ID NO: 4691

SEQ ID NO: 5611 - protein, 17 aa, Homo sapiens [sequence omitted]

SEQ ID NO: 5612 - protein, 44 aa, Homo sapiens
MVLVSIFCLFACFQNSLAWYCMESSSFSSCPLRAGLFPVSSQRP

SEQ ID NO: 5613 - protein, 27 aa, Homo sapiens
ELGFLYCFLCNMIAETHFKNSEACHSC

SEQ ID NO: 5614 - protein, 19 aa, Homo sapiens
MQALQTACFFFLLLAQPFQ

SEQ ID NO: 5615 - protein, 41 aa, Homo sapiens
  SITE (31): Xaa equals any amino acid
MILLSVSLGRHWAFTYKFFLTPVVFVFFFFXFFHRKEYINL

SEQ ID NO: 5616 - protein, 34 aa, Homo sapiens
MSGPLHGHHSLLRLLAACTLILPHSLAASVNVKN

SEQ ID NO: 5617 - protein, 26 aa, Homo sapiens
MCVSVLSIFVPQLHCLNYSSFVSLSI

SEQ ID NO: 5618 - protein, 137 aa, Homo sapiens
MVHLTTLLCKAHRGGHLTIRLALGGCTNRPFYRIVAAHNKCPRDGRFVEQLGSYDPLPNSHGEKLVALNLDRIRHWIGCGAHLSKPMEKLLGLAGFFPLHPMMITNAERLRRKRAREVLLASQKTDAEATDTEATET

SEQ ID NO: 5619 - protein, 106 aa, Homo sapiens
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 5620 - protein, 21 aa, Homo sapiens
MCHGGLVHLSTHHLSFKLCMQ

SEQ ID NO: 5621 - protein, 37 aa, Homo sapiens
  SITE (37): Xaa equals any amino acid
MVLLSPAMSLLIFCLPALSISKNKKKKKKKEFKKLLX

SEQ ID NO: 5622 - protein, 25 aa, Homo sapiens
MWLTVSWLHTFHALDFCAFCRNDSR

SEQ ID NO: 5623 - protein, 35 aa, Homo sapiens
MGTQLLFLLCSILIPLCVELDYIFLKQSSLNNLVV

SEQ ID NO: 5624 - protein, 31 aa, Homo sapiens
MVEWTLAVLVCHLFLILYLFLFCENCLVVSC

SEQ ID NO: 5625 - protein, 31 aa, Homo sapiens
MHFFLPKQVSFPLSLITLLWPSLILQKISRL

SEQ ID NO: 5626 - protein, 57 aa, Homo sapiens
MTCSRSSIFLTLLLLGHRAIFSNMPEKLRSLITDNLQLFTSKSFGQIMPVKECKFYK

SEQ ID NO: 5627 - protein, 44 aa, Homo sapiens
MLLAPAVGQLLYIYWTLYFSRSFLRWVGFVSTLQVRKVKLRELK

SEQ ID NO: 5628 - protein, 14 aa, Homo sapiens
VLYYPYLAIYNMKV

SEQ ID NO: 5629 - protein, 31 aa, Homo sapiens
MVMHTRLLFRMSLWPVNCGQETYCKKKKKKK

SEQ ID NO: 5630 - protein, 31 aa, Homo sapiens
MRLLLIWQAFLCPKLTKSSQSFLFLAYPISL

SEQ ID NO: 5631 - protein, 42 aa, Homo sapiens
MNCGTRGCENLRWNLSFFLSFFLNFVFSIQQQCVERILCRCR

SEQ ID NO: 5632 - protein, 57 aa, Homo sapiens
LPSSVRHGLAQVLALVTFQHVTLGTCDLHLSGFVSSLLRCRQCTYNICYFRAMRCTS

SEQ ID NO: 5633 - protein, 66 aa, Homo sapiens
MGPRLCPVLGSACPASTLCWLLLASYWVLPCRDKHTGPEKLGRHEQVAGPSWTSFVSDPTIIQGPI

SEQ ID NO: 5634 - protein, 38 aa, Homo sapiens
MIWSLATLLSSLLLNMSRAFPSQWAFVLTISSAWMFLL

SEQ ID NO: 5635 - protein, 22 aa, Homo sapiens
MVTNYRSQLSFLQSLPQFYTFC

SEQ ID NO: 5636 - protein, 43 aa, Homo sapiens
MSIKCLHKTLQVLYFMRFLLLIKATKMNGKFILIKSTTWEEVR

SEQ ID NO: 5637 - protein, 42 aa, Homo sapiens
MAETPSLSHEGLIGIKLGFLWLWVLFFCCCFWFSVCFLVYGG

SEQ ID NO: 5638 - protein, 17 aa, Homo sapiens
MSENPLLAKSPESKFCF

SEQ ID NO: 5639 - protein, 32 aa, Homo sapiens
AFLAAALAQGLCEVLLVVTKEVEEKGSWLRTD

SEQ ID NO: 5640 - protein, 20 aa, Homo sapiens
GKCLINLVIGWVKYMGEFYM

SEQ ID NO: 5641 - protein, 67 aa, Homo sapiens
DTWFVSTFWLLLTVLLCTFLSKSLFGNLFSNSLKYLGMELLSFMIIQSLPSRGTPATVLFYILISSV

SEQ ID NO: 5642 - protein, 34 aa, Homo sapiens
MQFTDSRQCCLLFTLILFTVLSQFYFLEEWYSVL

SEQ ID NO: 5643 - protein, 29 aa, Homo sapiens
MVTIIILQPSSFPLPLRLNCYNADYLYSS

SEQ ID NO: 5644 - protein, 3 aa, Homo sapiens
TVW

SEQ ID NO: 5645 - protein, 32 aa, Homo sapiens
MSQCYRDFVYGQFWGQFMARFWGACSQHQEMC

SEQ ID NO: 5646 - protein, 3 aa, Homo sapiens
MFS

SEQ ID NO: 5647 - protein, 38 aa, Homo sapiens
MTYRLIVIFSFLLLLFRLDLGKSPGWLEGLRFMWSFVF

SEQ ID NO: 5648 - protein, 36 aa, Homo sapiens
MSSVDFHVLSSPFDIRGLKTPPLDHANTAIFCAWVP

SEQ ID NO: 5649 - protein, 39 aa, Homo sapiens
MCILIPFASVLLRIFASGILVCSFLVSLSGFGVREMQAS

SEQ ID NO: 5650 - protein, 16 aa, Homo sapiens
MIIIAKVVLFFNSSAS

SEQ ID NO: 5651 - protein, 35 aa, Homo sapiens
  SITE (17): Xaa equals any amino acid
MYLRIKYVSKLPGLLLXFFFVLFLRLWYSWEMQIG

SEQ ID NO: 5652 - protein, 7 aa, Homo sapiens
NFLFFLC

SEQ ID NO: 5653 - protein, 22 aa, Homo sapiens
MLTYTIMFSLIVEVISGGLSFI

SEQ ID NO: 5654 - protein, 31 aa, Homo sapiens
MQKSKQPRILCLILLVIPTLLQQYSCTCHIK

SEQ ID NO: 5655 - protein, 25 aa, Homo sapiens
FLFVPNVFSSFKNGSHPTRLPPYQD

SEQ ID NO: 5656 - protein, 22 aa, Homo sapiens
  SITE (8): Xaa equals any amino acid
MKLVIMYXILLAVSSLTVIKVI

SEQ ID NO: 5657 - protein, 38 aa, Homo sapiens
MRILHFQLTCCYIPTIIRPWRPVAWFPLSLLCFFLWHG

SEQ ID NO: 5658 - protein, 32 aa, Homo sapiens
MCMHTSSLLFLLVLLSDTYEKDHFPSLFPFVG

SEQ ID NO: 5659 - protein, 3 aa, Homo sapiens
GVT

SEQ ID NO: 5660 - protein, 8 aa, Homo sapiens
MTKEDSKL

SEQ ID NO: 5661 - protein, 13 aa, Homo sapiens
MAVGTFGVWLWGN

SEQ ID NO: 5662 - protein, 49 aa, Homo sapiens
  SITE (26): Xaa equals any amino acid
  SITE (30): Xaa equals any amino acid
MAFFHLLKGTGLFPPSLSSSVLCFVXDLFXWTIHRSALLFLLPLSVFSC

SEQ ID NO: 5663 - protein, 29 aa, Homo sapiens
IKIVLLFSCLFLFLLFVFLTSLYWEVTPV

SEQ ID NO: 5664 - protein, 28 aa, Homo sapiens
MCLYQFIFLFYWLVVFYLECTTVYPFTS

SEQ ID NO: 5665 - protein, 6 aa, Homo sapiens
FLSSLS

SEQ ID NO: 5666 - protein, 57 aa, Homo sapiens
MEFLHDVGVDAIAFSLLVFLLTVRPLCCRSAGVCCGSTPDPVSLSITSGGCRTAKTD

SEQ ID NO: 5667 - protein, 31 aa, Homo sapiens
MGFYLRVLRLVYVFQELLGHCGSAAPGTSCA

SEQ ID NO: 5668 - protein, 69 aa, Homo sapiens
MGRWPGTAGSLTLTWLRVEIWLVPWSGTCHSPNPKQSRVWAQDCPLPFETPSLVPASKTNREATLVAGS

SEQ ID NO: 5669 - protein, 9 aa, Homo sapiens
MQINDYFLS

SEQ ID NO: 5670 - protein, 40 aa, Homo sapiens
GGIYKFTLTVCAAHIRFLVLGLFLYSLHGDWQHQHHMSTT

SEQ ID NO: 5671 - protein, 20 aa, Homo sapiens
MIENPGRLFLSSVLFCFFAL

SEQ ID NO: 5672 - protein, 34 aa, Homo sapiens
MLLLLFLFWSKGAAEGEPGPVPAPAGFSETQRWR

SEQ ID NO: 5673 - protein, 36 aa, Homo sapiens
MGQMLLSVLLLLQWLCSHSASNLSSFSSVFTHLGRW

SEQ ID NO: 5674 - protein, 35 aa, Homo sapiens
MVCLLLRTLCPLCSRGKTGLEVNLSLFLYIEGRDQ

SEQ ID NO: 5675 - protein, 62 aa, Homo sapiens
MFEVFHFLAFVSNMVWICGAIQISHQIVSLNVVGGAWWEVTGLYGWILMNHLIPLPLVLSLP

SEQ ID NO: 5676 - protein, 41 aa, Homo sapiens
MIFLLFCSTFPLFKTSALATQDLRGAFLESCLKQEQITQKH

SEQ ID NO: 5677 - protein, 23 aa, Homo sapiens
QHCCLSSASCLGSPLVWEDCCAP

SEQ ID NO: 5678 - protein, 48 aa, Homo sapiens
MIQTPPTRPHLLTLGWSTCFLVWSHEIRTGAHIQTMSHTIQRIIAMCK

SEQ ID NO: 5679 - protein, 37 aa, Homo sapiens
MEWLVSPSHFLFLTYFSLLVSLDGEVLFMIRKEGISY

SEQ ID NO: 5680 - protein, 14 aa, Homo sapiens
MRGVEFCLVFWPCW

SEQ ID NO: 5681 - protein, 32 aa, Homo sapiens
MVGIWVCVCHLSVSQALKNISYSWHSSVHFGK

SEQ ID NO: 5682 - protein, 43 aa, Homo sapiens
MPFLLLLHAIEHSLSSHRIQFSHLRKAFPDSNRQVMHLFPVLT

SEQ ID NO: 5683 - protein, 35 aa, Homo sapiens
MLSYKTSIFCLFLFFPPFLTRGEKKTEGKKGGNES

SEQ ID NO: 5684 - protein, 22 aa, Homo sapiens
MCVCVCMYMHVFMCFLGLISLK

SEQ ID NO: 5685 - protein, 31 aa, Homo sapiens
MLALKLVLTAFSLVGCLLESPIGTARAITSL

SEQ ID NO: 5686 - protein, 24 aa, Homo sapiens
MVYMPACAVVVSGILELALSASLL

SEQ ID NO: 5687 - protein, 31 aa, Homo sapiens
MYCLCPFLLPSSNPLYSYCGLCSTVVYPSTR

SEQ ID NO: 5688 - protein, 16 aa, Homo sapiens
MNSMNYLFIFLVSLEA

SEQ ID NO: 5689 - protein, 35 aa, Homo sapiens
MVLHLHLQLCLVSVCKSKSLVQPFQATWPKLTKHP

SEQ ID NO: 5690 - protein, 625 aa, Homo sapiens
MELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 5691 - protein, 35 aa, Homo sapiens
MPFVAWFCFCVFSTIHFSILASRKENQPSRLARLK

SEQ ID NO: 5692 - protein, 12 aa, Homo sapiens
WYSFCLVLRVSK

SEQ ID NO: 5693 - protein, 767 aa, Homo sapiens
MKGCLSCSYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 5694 - protein, 35 aa, Homo sapiens; identical to SEQ ID NO: 5691

SEQ ID NO: 5695 - protein, 35 aa, Homo sapiens; identical to SEQ ID NO: 5691

SEQ ID NO: 5696 - protein, 62 aa, Homo sapiens
MPLLQLFLFYYFLPSYLPSLPPETHTFLFFPLTIPGIFSRTTFLEVLLLLILKFAVPWLFSF

SEQ ID NO: 5697 - protein, 28 aa, Homo sapiens
MSRLREYLIFLLFFSSLAFNVETPFTSH

SEQ ID NO: 5698 - protein, 48 aa, Homo sapiens
MLPLATAKQCGIAGLECLLIFLLGFHIQFPLRGITWIIIGTLELMASM

SEQ ID NO: 5699 - protein, 30 aa, Homo sapiens
MSCFYILKVILHFLVLNYSIPIKICKILKT

SEQ ID NO: 5700 - protein, 47 aa, Homo sapiens
MIFKLCKFDSILLLGFYLILVVCFSFAEVSNCSSPTAPKFSILGAQL

SEQ ID NO: 5701 - protein, 32 aa, Homo sapiens
MPCMHCLLSSCILSACFSPCISIPWAPPVVPV

SEQ ID NO: 5702 - protein, 116 aa, Homo sapiens
SKNIFHAARTPATLFVVIFITYVIAGVTGFIGLDIIASLCNMIMGLTLITLCTWAYIRYSGEYRELGAVIDQVAAALWDQALYKLYSAAATHRHLYHQAFPTPKSESTEQSEKKKM

SEQ ID NO: 5703 - protein, 45 aa, Homo sapiens
RHSLFWILIQMILISTVSGSSQSALTPSACQGHPVQSLIEGEFPQ

SEQ ID NO: 5704 - protein, 23 aa, Homo sapiens
MLSIFCFIWFIYFLGFFMHILWH

SEQ ID NO: 5705 - protein, 36 aa, Homo sapiens
MPELFLLVPLPGTLLLSLSHGWPLSHSPSSYSETTF

SEQ ID NO: 5706 - protein, 33 aa, Homo sapiens
MLPIFVTLFFVCFVLFCLFCPTKTDLSSCDTTM

SEQ ID NO: 5707 - protein, 496 aa, Homo sapiens
RACNLPGRLRYAHRLSGFLHSHLRRIWLRRKWRCHWPRPLPQSCVGTEGGLQVRDTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 5708 - protein, 63 aa, Homo sapiens
MKLSSLSRLTKSTSTAGALWNVPTGRTWLLVLASTSISFSISSPTTSWNCSAASTGPMSLTPS

SEQ ID NO: 5709 - protein, 55 aa, Homo sapiens [sequence omitted]

SEQ ID NO: 5710 - protein, 96 aa, Homo sapiens
MVCQSLLLLDQLSCPSVSFLGLLCGLLVCKHLSVSKPAVRSSLTITEYTWYTKTHVEEKKITEVPKNTYNWTKNWLIFFFKERAASVYYLQRSSFH

SEQ ID NO: 5711 - protein, 25 aa, Homo sapiens
MYQVVPLKKCLSLLGTLMTQPITLA

SEQ ID NO: 5712 - protein, 169 aa, Homo sapiens
MAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 5713 - protein, 13 aa, Homo sapiens
MSPCPLLCFSVGF

SEQ ID NO: 5714 - protein, 14 aa, Homo sapiens
MLPCVLDGFLQACL

SEQ ID NO: 5715 - protein, 48 aa, Homo sapiens
MELLCWSCWCVCLGWLHTGWPASGTALGTMRSLTRTPRQSATTAGCTN

SEQ ID NO: 5716 - protein, 38 aa, Homo sapiens
EPLCLSRLVLSTVHFSLSVPWALMKKQNAPNFIHLPSL

SEQ ID NO: 5717 - protein, 72 aa, Homo sapiens
MSSKTASTNNIAQARRTVQQLRLEASIERIKVSKASADLMSYCEEHARSDPLLIGIPTSENPFKDKKTCIIL

SEQ ID NO: 5718 - protein, 57 aa, Homo sapiens
WVDWQRKWTTKFFMLRSFLLETSQIFRFLWIMKQKSTEDLLLLNLSWQRMLQQLSTT

SEQ ID NO: 5719 - protein, 93 aa, Homo sapiens
GKGSQPPSPPSPAPSSFSSTSVSSLEAEAYAAFPGLGQVPKQLAQLSEAKDLQARKAFNCKYCNKEYLSLGALKMHIRSHTLPCVCGTCGKLL

SEQ ID NO: 5720 - protein, 36 aa, Homo sapiens
MGSCTWSIWLWMVSGVACRSQGLSDCSPKAFLWSFA

SEQ ID NO: 5721 - protein, 21 aa, Homo sapiens
MYQTAWIDSLPLLSFLVTSVT

SEQ ID NO: 5722 - protein, 37 aa, Homo sapiens
MGLVSNFVIFLVFVSDFLFKNKVLSECFDFPVTTKFL

SEQ ID NO: 5723 - protein, 26 aa, Homo sapiens
MAHSTARWLWWLPRMWTPVPSWRYSL

SEQ ID NO: 5724 - protein, 4 aa, Homo sapiens
YSLT

SEQ ID NO: 5725 - protein, 57 aa, Homo sapiens
EPPSLELWEKLLLLEVPVAEKFPNRTDSFIPPEFRERSMWTHVPLHQRLLSRHSSST

SEQ ID NO: 5726 - protein, 111 aa, Homo sapiens
FLLFLLFLLQGKYKISLEWASRFIQPPPGHRFREREEEGRFGASTTTSFPHALLSPFPSFSTSSFPSLPSMICPCPSVSSSFPSFLPFLLPSLAGSNEQVALNLDSTITGG

SEQ ID NO: 5727 - protein, 32 aa, Homo sapiens
MSPPALFLFIHVLFLYQYCFGYVESLAFLYKF

SEQ ID NO: 5728 - protein, 15 aa, Homo sapiens
MWSVRSILFVLLSLM

SEQ ID NO: 5729 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 5730 - protein, 36 aa, Homo sapiens
MEKREAYISSHLLSMSLLRTCLILRMVVWLSSLGRR

SEQ ID NO: 5731 - protein, 14 aa, Homo sapiens
MPFIPSFPFLWPLL

SEQ ID NO: 5732 - protein, 1 aa, Homo sapiens
M

SEQ ID NO: 5733 - protein, 30 aa, Homo sapiens
MLVALLCLIRILGEMESFPQGAAGGRIGSI

SEQ ID NO: 5734 - protein, 12 aa, Homo sapiens
EQSLLYFILCCF

SEQ ID NO: 5735 - protein, 44 aa, Homo sapiens [sequence omitted]

SEQ ID NO: 5736 - protein, 31 aa, Homo sapiens
MLPLLIWFLASPCVLRASQTIHLWVALLFVI

SEQ ID NO: 5737 - protein, 181 aa, Homo sapiens
QLAAPAFPSPSLSYRFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVDTPYPESKARPHLMEPGHGPLLPLPCRPLHI

SEQ ID NO: 5738 - protein, 4 aa, Homo sapiens
MIIL

SEQ ID NO: 5739 - protein, 4 aa, Homo sapiens
MIIL

SEQ ID NO: 5740 - protein, 4 aa, Homo sapiens
MIIL

SEQ ID NO: 5741 - protein, 4 aa, Homo sapiens
MIIL

SEQ ID NO: 5742 - protein, 39 aa, Homo sapiens
MYSLASIMQIKKYFSLSVFLALVSSCCFCLDLERLQLSN

SEQ ID NO: 5743 - protein, 20 aa, Homo sapiens
MSATVSGRSHLWPLFACEKV

SEQ ID NO: 5744 - protein, 97 aa, Homo sapiens
LMLSLCLPPILSGTGDGGSPCEPFSCCSGRASSTLSQPGPMENDGLGFLRPYLMPLQFMSPTRPRGSGWERAPGCPVTPLTLPSPVPNMPCNKIRED

SEQ ID NO: 5745 - protein, 19 aa, Homo sapiens
MVVCHTHLWDSAWLFGCHL

SEQ ID NO: 5746 - protein, 17 aa, Homo sapiens
CVFTVDWSLKAPLGENM

SEQ ID NO: 5747 - protein, 36 aa, Homo sapiens
MSIFRCFKLPFVFEAFLIFLAISYFLFCDKKIRQTC

SEQ ID NO: 5748 - protein, 38 aa, Homo sapiens
MVDPLAISCGVLLLLCHFSMPEDTKMISRQSYHIAASL

SEQ ID NO: 5749 - protein, 81 aa, Homo sapiens
MRTNQSLCSFLLWSVPFHQAACPQAKDHPLEPSMHPEGTQLQSCSTMLGPRQLSSEKQPLLPPRSHLKSSPMLRACKGLTS

SEQ ID NO: 5750 - protein, 50 aa, Homo sapiens
MAILRTWIKISMMTVLMTVTPTNQMEKVTGMNLCTVIMVRETTMKKRSQV

SEQ ID NO: 5751 - protein, 16 aa, Homo sapiens
MLTGVLLSHILCAVIC

SEQ ID NO: 5752 - protein, 46 aa, Homo sapiens
MSLLSNVTWSFYTLHFFFIIMKNGIPPGSSKILLTETNVGVRKITI

SEQ ID NO: 5753 - protein, 26 aa, Homo sapiens
MFTVLLLELFSHPTYAGFSIAFEFCV

SEQ ID NO: 5754 - protein, 51 aa, Homo sapiens
MLPHLPLSGSLLCLSCSVRSFSCSTDWLPPSDSGTWLSKLTNFTSCNIHHQ

SEQ ID NO: 5755 - protein, 61 aa, Homo sapiens
WRRGVGSCCWPSQPCWWPTSARLRTRTVPSSVCSCRWTTWSPVWPWSARKLLQSCRRTSMS

SEQ ID NO: 5756 - protein, 115 aa, Homo sapiens
MKPVSLISLSILSLWGILVAFLVTECACRTLSSPWPLAAVLCSPCLCRAWPPQQACWLWASPVLRLHAHSLGSLSHLGSGPTSKLVNLGLHPVARCLLPDAFACLSHTGSSSKAP

SEQ ID NO: 5757 - protein, 13 aa, Homo sapiens
MIIYLYLFVVIVA

SEQ ID NO: 5758 - protein, 345 aa, Homo sapiens
MAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQHLRGFFSDSTSFNILMDMLFIKGKYKSALQVLIEMKNQDVKFTKDTYVLAFAICYKLNSPESFKICTTLREEALLKGEILSRRASCFAVALALNQNEMAKAVSIFSQIMNPESIACINLNLAKVREKVKDVPALVAKFDEIYGTLHITGQVTTDSLDAVLCHTPRDRKSHTLLLNKRMVSRRTFQPLSQSLLAE

SEQ ID NO: 5759 - protein, 107 aa, Homo sapiens
MGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGS

SEQ ID NO: 5760 - protein, 42 aa, Homo sapiens
MFAASIWSALPVCLFLFSVFSIFSSLVHAFCFALVPGAYLPN

SEQ ID NO: 5761 - protein, 69 aa, Homo sapiens
MFYSVAFSIFAMLCNHRHYPFLELFRHPRQTLCIHKKITSYLSLPLVFGNLCYTGKLCWLCVCVEFGLF

SEQ ID NO: 5762 - protein, 350 aa, Homo sapiens
MRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 5763 - protein, 36 aa, Homo sapiens
MVSCFTGVDSTWLLYIVFFVFFIDIVVHIFRIHMVF

SEQ ID NO: 5764 - protein, 58 aa, Homo sapiens [sequence omitted]

SEQ ID NO: 5765 - protein, 5 aa, Homo sapiens
PGNLL

SEQ ID NO: 5766 - protein, 10 aa, Homo sapiens
MCFLLLPCLL

SEQ ID NO: 5767 - protein, 30 aa, Homo sapiens
MALLYFTSLLLIPRTMSSTLYVLNKYLVGG

SEQ ID NO: 5768 - protein, 26 aa, Homo sapiens
MQCQLLCLVVYLFLFVLVMLTYVFSV

SEQ ID NO: 5769 - protein, 15 aa, Homo sapiens
MHNSNFAYHLLLNLQ

SEQ ID NO: 5770 - protein, 45 aa, Homo sapiens
MKAPPSHWSLWLSFCHPPPWLFALNKLAQRALEKHFIPSSYANSV

SEQ ID NO: 5771 - protein, 53 aa, Homo sapiens
MLFLLCSYFICVSHSFVSTYYSVYFCFLTCLHSVVPTYMLRSQMDYDIRKKAE

SEQ ID NO: 5772 - protein, 4 aa, Homo sapiens
METD

SEQ ID NO: 5773 - protein, 9 aa, Homo sapiens
LVTVSSHKI

SEQ ID NO: 5774 - protein, 46 aa, Homo sapiens
MPVTPFSSFFCASMIVTPFLFFFFFETAWATERDSISKKKKKYIYI

SEQ ID NO: 5775 - protein, 12 aa, Homo sapiens
KILIVLLWLVLQ

SEQ ID NO: 5776 - protein, 28 aa, Homo sapiens
PRLACLLSSLLLRIVFLPHTPLAPCSLL

SEQ ID NO: 5777 - protein, 34 aa, Homo sapiens
MPRPSLTLGLLLPSQHLCANHTLLQHFFNPKIIA

SEQ ID NO: 5778 - protein, 16 aa, Homo sapiens
MCVTAIYKPIWCNSYP

SEQ ID NO: 5779 - protein, 29 aa, Homo sapiens
MKLLFFLMRDVNSISLLYLITCLPCFCVT

SEQ ID NO: 5780 - protein, 14 aa, Homo sapiens
MASHGGFDLHFPGV

SEQ ID NO: 5781 - protein, 8 aa, Homo sapiens
MVNLCLEV

SEQ ID NO: 5782 - protein, 55 aa, Homo sapiens
MKEAFRWALFSMQATGHVLLGTSCYLQQLLDATEEGQPPKGKASSLIPTCLKILQ

SEQ ID NO: 5783 - protein, 55 aa, Homo sapiens
IPLTMRLTKTFTFVQKVKKKKTWLRKRRHVTSSYTPITVALQKIKITTFKKINLI

SEQ ID NO: 5784 - protein, 12 aa, Homo sapiens
MFSLEVLFLFAG

SEQ ID NO: 5785 - protein, 43 aa, Homo sapiens
LCLITWLLFPTCTMTKMPSTYLIQPFQYNSYTCHLSKPKGTSS

SEQ ID NO: 5786 - protein, 18 aa, Homo sapiens
MSSLQIFSPILWLVSSLC

SEQ ID NO: 5787 - protein, 55 aa, Homo sapiens
  SITE (18): Xaa equals any amino acid
  SITE (31): Xaa equals any amino acid
MIAAPLWSACFLVRVPSXVSLGAPSSLSSSXSPLAVAVVAAHAPGIPLQHSLLSS

SEQ ID NO: 5788 - protein, 37 aa, Homo sapiens
MKQICTGTIALLWLEMPLFWGQTFKMPLCLPVRSPKH

SEQ ID NO: 5789 - protein, 37 aa, Homo sapiens
MIIWGCLLIVSVCVEGTESFRLGNSNLLFMIKYKSRM

SEQ ID NO: 5790 - protein, 44 aa, Homo sapiens
MFVISHVLVICCLWVWTEFVGKTIFCIGYSSQQCPPQKAFSQNI

SEQ ID NO: 5791 - protein, 33 aa, Homo sapiens
  SITE (26): Xaa equals any amino acid
  SITE (32): Xaa equals any amino acid
MTFLTSFPIILHLAPCSSCSSFFFFXLFQICXF

SEQ ID NO: 5792 - protein, 49 aa, Homo sapiens
MASGFLFCWAKALWGWRGWCWCCTGLTAALTQRFPPSLLPVCCVDLFLV

SEQ ID NO: 5793 - protein, 33 aa, Homo sapiens
CMFILVNMIVVSAPVAHGVLPRICDSVNDMYLN

SEQ ID NO: 5794 - protein, 45 aa, Homo sapiens; identical to SEQ ID NO: 3194
  SITE (31): Xaa equals any amino acid

SEQ ID NO: 5795 - protein, 13 aa, Homo sapiens
HVLFDAFSLLHCF

SEQ ID NO: 5796 - protein, 81 aa, Homo sapiens
  SITE (22): Xaa equals any amino acid
MECLLYRTICLFYFLVRFLFSXLLLMKLFLPIINPNSWTLWLGNSLNFQPYGIIVSLSLSLLLSLFSSSPYFLSNKYCLLI

SEQ ID NO: 5797 - protein, 218 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 5798 - protein, 30 aa, Homo sapiens
MASSLLAQIVLGGWLFVGAFNIQRGEYCSD

SEQ ID NO: 5799 - protein, 12 aa, Homo sapiens
MTKILWLFLFLL

SEQ ID NO: 5800 - protein, 27 aa, Homo sapiens
MFGVLLVYLLFYTFATISLVNGMVWGF

SEQ ID NO: 5801 - protein, 22 aa, Homo sapiens
EWNIFLLFSCICLYFSLMNDWS

SEQ ID NO: 5802 - protein, 12 aa, Homo sapiens
RPLWGLGKRSLH

SEQ ID NO: 5803 - protein, 27 aa, Homo sapiens
  SITE (11): Xaa equals any amino acid
  SITE (27): Xaa equals any amino acid
MKSDLGPELQXSLILQNTIISAYEKDX

SEQ ID NO: 5804 - protein, 31 aa, Homo sapiens
MWPCMTLLLLYFLFPFQMGIRTVGQQQSQSQ

SEQ ID NO: 5805 - protein, 30 aa, Homo sapiens
TLITCFANFKCLNISETSSKYVGQLKNFDC

SEQ ID NO: 5806 - protein, 43 aa, Homo sapiens
MPLLFFSVSTLFSGSVTLQQRGMFLPWTGTGNRCLPCYGHGLN

SEQ ID NO: 5807 - protein, 20 aa, Homo sapiens
KQLYLESYCLGFLIRHSSPD

SEQ ID NO: 5808 - protein, 14 aa, Homo sapiens
LRPRSPGLAGRGCL

SEQ ID NO: 5809 - protein, 73 aa, Homo sapiens
MGCFVVVVVFVVGHLSIFSHQFCSLLAMDKIGSFWLIKKDNFIKWHFKQAIVSFIICNAHGKAKTFVMKELLI

SEQ ID NO: 5810 - protein, 117 aa, Homo sapiens
VAVHLFALMISTCILPNIEAVSNVHNLNSVKESPHERMHRHIELAWAFSTVIGTLLFLAEVVLLCWVKFLPLKKQPGQPRPTSKPPASGAQPTSAPAASPRARQLPSPRPPSWCPSA

SEQ ID NO: 5811 - protein, 34 aa, Homo sapiens
MSNERFRFRSLTFHLPLFPVVAMFPRLPSQKPCE

SEQ ID NO: 5812 - protein, 27 aa, Homo sapiens
MARHSTSTCFRRSWWRTWCLAAGWAPP

SEQ ID NO: 5813 - protein, 28 aa, Homo sapiens
MVKTVFAHCFLLFHLVTNDQDDLIFFPS

SEQ ID NO: 5814 - protein, 14 aa, Homo sapiens
MCPRLLFSWAFLSR

SEQ ID NO: 5815 - protein, 56 aa, Homo sapiens [sequence omitted]

SEQ ID NO: 5816 - protein, 39 aa, Homo sapiens
MRMLREIVGCLEFHYIFCFYFLIPRCFLKYSDKYLSYID

SEQ ID NO: 5817 - protein, 36 aa, Homo sapiens
MQLFSLFFSFPPSLHPSPIPPSLPYSSRLPPSLPPS

SEQ ID NO: 5818 - protein, 36 aa, Homo sapiens
MDNRTALSVGMVVLLEDCIIGGLVSSSLPGQSSEVL

SEQ ID NO: 5819 - protein, 92 aa, Homo sapiens
MACILFSLLCLILFDFPLQHSVSVKGFYAFTSHVLNTLRTTHLVFTLLPVNVWNLESHRVALKQCVFSLRSSAHFATTREEFSAKANPCSLT

SEQ ID NO: 5820 - protein, 22 aa, Homo sapiens
ERCLLILCVVTQRSSTFPSLCR

SEQ ID NO: 5821 - protein, 70 aa, Homo sapiens
MWLLINLTASRCSSPPCQALCLLIALWGHSLIYSPALGNRSCHYPSLSAQGKINALRIVIIFPRLPSWWC

SEQ ID NO: 5822 - protein, 27 aa, Homo sapiens
ARVCSKVTLLLFWTLLSGKKGCRLPAM

SEQ ID NO: 5823 - protein, 350 aa, Homo sapiens [sequence omitted]

SEQ ID NO: 5824 - protein, 55 aa, Homo sapiens
MYCLWLLLLYNSWVEYLEQRPNVWQKSNIFTILYRKKMSTYIYTYYNFSKNTEFK

SEQ ID NO: 5825 - protein, 27 aa, Homo sapiens
MTVMVTLLFLLRYVTALRLTRATWSCW

SEQ ID NO: 5826 - protein, 71 aa, Homo sapiens
MIMSSSNSSIWPAMPCMLLSVYSYLFSCISHGSPRLSALQPPKPCSSFSNSSAPYLRAFASARCTSFPYFT

SEQ ID NO: 5827 - protein, 57 aa, Homo sapiens
MDFLCFLLLSGATPALTSSGTSCQHSPHSLMPQSCHTRLIPCLPVCLQPDAARPRLP

SEQ ID NO: 5828 - protein, 2 aa, Homo sapiens
FP

SEQ ID NO: 5829 - protein, 24 aa, Homo sapiens
IRRVLWAPGQPSCLSSPAVSRGRW

SEQ ID NO: 5830 - protein, 24 aa, Homo sapiens
IRRVLWAPGQPSCLSSPAVSRGRW

SEQ ID NO: 5831 - protein, 24 aa, Homo sapiens
IRRVLWAPGQPSCLSSPAVSRGRW

SEQ ID NO: 5832 - protein, 54 aa, Homo sapiens
MCQTWARCLRLMFHPTCLTCPALPTTSCTLPTWAPALPPLPLAPFQNCPPSTLR

SEQ ID NO: 5833 - protein, 13 aa, Homo sapiens
MLPGVLWYLARCR

SEQ ID NO: 5834 - protein, 31 aa, Homo sapiens
MVGPRLPMGLLFVASFLFLFIQCVHMPRSYL

SEQ ID NO: 5835 - protein, 89 aa, Homo sapiens
  SITE (67): Xaa equals any amino acid
  SITE (70): Xaa equals any amino acid
  SITE (79): Xaa equals any amino acid
MRSPHVRVHLVYFQRLARGSDERTCSAPAFSSFREFSRGLQRFPHAASHSSCTIVHSNSNGQGLQSXRIXANIYYFMWXFFLFFFFFFF

SEQ ID NO: 5836 - protein, 11 aa, Homo sapiens
VKTSHVFESEN

SEQ ID NO: 5837 - protein, 91 aa, Homo sapiens
MNKSTFLFLIIMWPNVYISLSVAHHIVLTKTISSFTPAQIFKYSLLFPTSVSGIAILFKTYLKNVQASHLCVKLFSLFQCDEKNWTEHTFL

SEQ ID NO: 5838 - protein, 37 aa, Homo sapiens
MYMLVCICVFILNSYICCIYLVLSMLYDSTTSKMDQV

SEQ ID NO: 5839 - protein, 40 aa, Homo sapiens
LCLMCWWLPGGLASDSEEDTKKLIVSLNWLFYLLRLCLSY

SEQ ID NO: 5840 - protein, 36 aa, Homo sapiens
MHLCCNLCWYALDLVFPWFFAAVSQVARFDISLSLI

SEQ ID NO: 5841 - protein, 2 aa, Homo sapiens
SL

SEQ ID NO: 5842 - protein, 31 aa, Homo sapiens
MGMSSPAFQKQKEGQSDLLVPAFCFCFCFCF

SEQ ID NO: 5843 - protein, 15 aa, Homo sapiens
MCIFLVSTSTLLALP

SEQ ID NO: 5844 - protein, 6 aa, Homo sapiens
MISVHL

SEQ ID NO: 5845 - protein, 44 aa, Homo sapiens
  SITE (14): Xaa equals any amino acid
  SITE (26): Xaa equals any amino acid
  SITE (27): Xaa equals any amino acid
MCLLIVTPGIGFLXFIVRIGGSGDTXXVEWRRKDLLIIREEHVG

SEQ ID NO: 5846 - protein, 28 aa, Homo sapiens
KELLISLVASLFMGFGVLFLLLWVGIYV

SEQ ID NO: 5847 - protein, 25 aa, Homo sapiens
MKSCLWFLTSLSRVSASLGELHISS

SEQ ID NO: 5848 - protein, 23 aa, Homo sapiens
MFQWFFLFVVFVFVLPFSFTGLF

SEQ ID NO: 5849 - protein, 18 aa, Homo sapiens
MCLCVCVCVCARACALVA

SEQ ID NO: 5850 - protein, 21 aa, Homo sapiens
MFSCFFLLPMFCILTPLLSGI

SEQ ID NO: 5851 - protein, 26 aa, Homo sapiens
MQCVYHSIWYTAMVIPFLFSFQIIAP

SEQ ID NO: 5852 - protein, 5 aa, Homo sapiens
MNNDC

SEQ ID NO: 5853 - protein, 92 aa, Homo sapiens
VGSPTRQIATLLCLALWILPLLFLPSLCLWLYPSPPSISLSLVSLLSLDHVFFISMYLPLVMCASYLKVCPSFISFVNLGNYMSIPGLFWIE

SEQ ID NO: 5854 - protein, 9 aa, Homo sapiens
FCTHAFTSE

SEQ ID NO: 5855 - protein, 100 aa, Homo sapiens
  SITE (14): Xaa equals any amino acid
  SITE (22): Xaa equals any amino acid
  SITE (30): Xaa equals any amino acid
  SITE (45): Xaa equals any amino acid
  SITE (50): Xaa equals any amino acid
MCPSALHTFTPAMXSCAAYLGXPTQCSTSXPAPLKTQSHMNLAFXFSNIXTSVLLVPTSPSPAWRKGYFQGTTVVQLSQVFLLSINHPAALGCPASQPSG

SEQ ID NO: 5856 - protein, 16 aa, Homo sapiens
MAKKVPVYLMPSFPCC

SEQ ID NO: 5857 - protein, 16 aa, Homo sapiens
VATVSGEQNRTTVILG

SEQ ID NO: 5858 - protein, 36 aa, Homo sapiens
QQRLPWKSTTFPFFMGLSSLWESLEIPLLFTATSSL

SEQ ID NO: 5859 - protein, 1 aa, Homo sapiens
G

SEQ ID NO: 5860 - protein, 34 aa, Homo sapiens
  SITE (8): Xaa equals any amino acid
  SITE (9): Xaa equals any amino acid
  SITE (10): Xaa equals any amino acid
LFSCCLFXXXVLKPCLGHPTGELGHHLALWWQWG

SEQ ID NO: 5861 - protein, 52 aa, Homo sapiens
LLLLLAVVGTRWLLPAAAAAYPPPDWSRWPWASSPPPPWLCPPAAPGSHRGR

SEQ ID NO: 5862 - protein, 57 aa, Homo sapiens
MIPMRKVNTSLWFSLCLLQLTLQIWKQYGRRQNRKTLWIQNLDVCLNCQQRMINHMM

SEQ ID NO: 5863 - protein, 47 aa, Homo sapiens [sequence omitted]

SEQ ID NO: 5864 - protein, 79 aa, Homo sapiens
MGLRPPQAQMPPPMPALGSSGPHPPVPPTHPNMEGLCLPRACLSGACRTLPETLRTAPRKSSLMPTKASRTVRRSSPRR

SEQ ID NO: 5865 - protein, 63 aa, Homo sapiens
MAFILLFYCLMTFLSLEQNSATVEPSSHEILHLLQNCFELLRTSTSQCTEGIPCQRYQNGLHI

SEQ ID NO: 5866 - protein, 168 aa, Homo sapiens
MSGLSGPPARRGPFPLALPAQHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 5867 - protein, 35 aa, Homo sapiens
MYVCVWLIFTSKFLRFMLLCVSEVSFYLLLSSIHL

SEQ ID NO: 5868 - protein, 35 aa, Homo sapiens
MWCALGFWGRAWGSRGPWAAQPGEPQPRGWSCSGN

SEQ ID NO: 5869 - protein, 35 aa, Homo sapiens; identical to SEQ ID NO: 5868

SEQ ID NO: 5870 - protein, 35 aa, Homo sapiens; identical to SEQ ID NO: 5868

SEQ ID NO: 5871 - protein, 52 aa, Homo sapiens
MYRAVSLPGAMGWACPAVMAPCFLLLGAGSRTLPTIHAVAPRAEPLLVLWQP

SEQ ID NO: 5872 - protein, 15 aa, Homo sapiens
MPANVQMQLVDTKAG

SEQ ID NO: 5873 - protein, 18 aa, Homo sapiens
MSVTSAWCGVWIIYRIIK

SEQ ID NO: 5874 - protein, 215 aa, Homo sapiens
DAVLAWWLCLEWQHLHVQLAPSAYGCWHGGILWRCVTGVPPAPVVGGAQTALETPPCSAAPDGLRPHCCGAGCCLYVSQPWKDCQPLLPSQLAGHHHCLPLRLPVVPGLCCLPPALGVHVAAQLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 5875 - protein, 39 aa, Homo sapiens
MPARVCFCAAAQGGAAAAHCAAGTQEWGVAPAGRRVPRD

SEQ ID NO: 5876 - protein, 24 aa, Homo sapiens
MSQYCFLLAGVLSSLLTPATKADF

SEQ ID NO: 5877 - protein, 21 aa, Homo sapiens
ISRRCILFDNSFSYRLPLQTT

SEQ ID NO: 5878 - protein, 200 aa, Homo sapiens
MHSLVLLCPLCSDPCGVCVAPKHSHSQGQQPDSELHPPCLPHTLLSLFLALHRPPQPCHLPPLTDHLCSCVHSGCVFCRAFQAIRPESRIRKWMGPQKTNSVVFLCSFTQVTLCGIWLGTEPPFVNKDPQFMPGYIIIQCNEGSVTAFYSVLGYLGFLVLGSLAVAFLARNLPDAFNEAKFLTFSMLVSCSVWVAFLPSY

SEQ ID NO: 5879 - protein, 51 aa, Homo sapiens
MLCNLHFLYFWHFFANGTCNSTLQIARVVSSLTPSQNTAFIVVSLSRELGY

SEQ ID NO: 5880 - protein, 54 aa, Homo sapiens
DLHFTLACSVLFVWAYSSRRNLPEVPSVTNSALSMESCYCQTGGLRDMLFSATS

SEQ ID NO: 5881 - protein, 35 aa, Homo sapiens
MFVTPPRLTFNLFTLRSWFYVCDCLLSLLLSPSGR

SEQ ID NO: 5882 - protein, 54 aa, Homo sapiens
MSFYRLVHSNQDLNSLRGLLMEFVFLFHLFQSKAVFPSFSFPCCCLVEIQSSIQ

SEQ ID NO: 5883 - protein, 76 aa, Homo sapiens
  SITE (51): Xaa equals any amino acid
MPIPFPGEQVHLPFLSLLAHWHQTQLPSKGPLASRAQIQPFSQEPLGHLAXTQLTSQGPLACRVQVQLPSQGLLAH

SEQ ID NO: 5884 - protein, 38 aa, Homo sapiens
MIHSLLLLLLLLLLLLILLRISISRLTGTNTLVFNLIL

SEQ ID NO: 5885 - protein, 37 aa, Homo sapiens
MQEARQQITTVVLPTLAVVVLLIVVFVYVATRPTITE

SEQ ID NO: 5886 - protein, 21 aa, Homo sapiens
MTHYVFLLLFMVGRGDEGKSG

SEQ ID NO: 5887 - protein, 41 aa, Homo sapiens [sequence omitted]

SEQ ID NO: 5888 - protein, 53 aa, Homo sapiens
MSNLSLRYSSSKGSWGSLFPNIRIMQIFLLMVDAHCVYISQPFKHESEKSFSK

SEQ ID NO: 5889 - protein, 17 aa, Homo sapiens
MWLSREVLVLISISASG

SEQ ID NO: 5890 - protein, 20 aa, Homo sapiens
MNPCFFSVLVLLPELALQWK

SEQ ID NO: 5891 - protein, 30 aa, Homo sapiens
MLLCFMRIKIPALLCLWYLPLHILVMAWEV

SEQ ID NO: 5892 - protein, 33 aa, Homo sapiens
MPLLLRWVSWLQVWKPRPPLSRRRKTSQLKPRS

SEQ ID NO: 5893 - protein, 233 aa, Homo sapiens
EILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPPRNPSL

SEQ ID NO: 5894 - protein, 49 aa, Homo sapiens
MHLFICTLWNIFCNKPVSWSSVSCSNKFIKPKEGVVGIPIYRRLVRSTS

SEQ ID NO: 5895 - protein, 20 aa, Homo sapiens
MILSTNLFTDLFILFLVLHS

SEQ ID NO: 5896 - protein, 12 aa, Homo sapiens
MAHPNRILLVPW

SEQ ID NO: 5897 - protein, 35 aa, Homo sapiens
MTKIVNTSLFLASVTIIVSATSGVEQPSTQRSLAF

SEQ ID NO: 5898 - protein, 66 aa, Homo sapiens [sequence omitted]

SEQ ID NO: 5899 - protein, 30 aa, Homo sapiens
MLSSVMLLSVLQVHLHLRAELHLLPLPLQR

SEQ ID NO: 5900 - protein, 29 aa, Homo sapiens
VNLDHLVKVVFARFLHYKVNIFPFPYYFL

SEQ ID NO: 5901 - protein, 38 aa, Homo sapiens
MCEARQLLVLQLLCGKQKPFCSVPQPAFVSRIEELFHK

SEQ ID NO: 5902 - protein, 17 aa, Homo sapiens
MKIRKRRNWASWRISVV

SEQ ID NO: 5903 - protein, 24 aa, Homo sapiens
  SITE (21): Xaa equals any amino acid
MVIIFILYILCIPVIKCRVLXSII

SEQ ID NO: 5904 - protein, 6 aa, Homo sapiens
IVLWLQ

SEQ ID NO: 5905 - protein, 41 aa, Homo sapiens
MEISAVTLGLLIRSVWGGAQESAFLIRSPAPLPHYSSAKRS

SEQ ID NO: 5906 - protein, 29 aa, Homo sapiens
MAVGLVVFFTTFLTPAAYVLGNLKQFRRN

SEQ ID NO: 5907 - protein, 11 aa, Homo sapiens
MGKRHRGKRMV

SEQ ID NO: 5908 - protein, 24 aa, Homo sapiens
MKEELWSVFRWVIILLQCRILMLP

SEQ ID NO: 5909 - protein, 40 aa, Homo sapiens
MIVLGWMFFVGLVCYMGTFPELMEPCGRDINIPQEGLQWK

SEQ ID NO: 5910 - protein, 17 aa, Homo sapiens
  SITE (12): Xaa equals any amino acid
MLSGWLFWLLWXSCISR

SEQ ID NO: 5911 - protein, 37 aa, Homo sapiens
MFLAVLLLILMLFLILVYHQVYISHGEKKIGLMYQGP

SEQ ID NO: 5912 - protein, 33 aa, Homo sapiens [sequence omitted]

SEQ ID NO: 5913 - protein, 44 aa, Homo sapiens
MFFGLLLMILFTLCQILSCRLFYNSTFKKNVYANLLSIFMSIFI

SEQ ID NO: 5914 - protein, 31 aa, Homo sapiens
MFCVVVLSLEATGYGRFTFTGGPLMTTAPST

SEQ ID NO: 5915 - protein, 35 aa, Homo sapiens
MSWCLDLRTTQRTLTIPALVHTTQRRSHRQKLPGQ

SEQ ID NO: 5916 - protein, 322 aa, Homo sapiens
MEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 5917 - protein, 32 aa, Homo sapiens
MNFKFPCATTVFILTTLKPVVSSFCYCEVDTQ

SEQ ID NO: 5918 - protein, 21 aa, Homo sapiens
CDIAFFLFLLLFSAAADLEMK

SEQ ID NO: 5919 - protein, 142 aa, Homo sapiens
  SITE (111): Xaa equals any amino acid
MHQLLQLQRQEPCRLLSPSPQPGLHHLCFQQIELLLLLLHLQWGLGLLRQLHHKRLAQLLLHRRRDHPIPPIQDILGIAKCPCPWAIILMRMASIICHIHQCITRVLDRLXTRDPSSLHTPSLSPHSSLTIHSSNMSAQQLS

SEQ ID NO: 5920 - protein, 10 aa, Homo sapiens
MRFFCVIFVF

SEQ ID NO: 5921 - protein, 23 aa, Homo sapiens
HLHVSLLSFPPLFIHSANLSANQ

SEQ ID NO: 5922 - protein, 23 aa, Homo sapiens
MHVFLTFIGLSGTFCELPVTFLC

SEQ ID NO: 5923 - protein, 52 aa, Homo sapiens
MLREFWLLFLFCLGREHMSKCDKCEQIIWRGEEIQERGGPVFSLFWKNNHFS

SEQ ID NO: 5924 - protein, 34 aa, Homo sapiens
MKNLTHFFLSLSSLSSFLFLVSSSFSRRAGPGQG

SEQ ID NO: 5925 - protein, 42 aa, Homo sapiens
MMTITFCVYLPILSLWHWLVMRNGHTTIQMEVQLGFPKSPLM

SEQ ID NO: 5926 - protein, 16 aa, Homo sapiens
MNGLCILTHLILSTIL

SEQ ID NO: 5927 - protein, 34 aa, Homo sapiens
MRDLVLKIVFFYNFLGITCFTVAGTNLINPVFEQ

SEQ ID NO: 5928 - protein, 73 aa, Homo sapiens
  SITE (13): Xaa equals any amino acid
  SITE (36): Xaa equals any amino acid
  SITE (40): Xaa equals any amino acid
  SITE (51): Xaa equals any amino acid
  SITE (62): Xaa equals any amino acid
MISFIRYQLFLHXIKIILHWLILIFCWSSHFPGSHXPHSXPAKVKVGNLWXWKQSQVTWPTXEMEPMALPMHL

SEQ ID NO: 5929 - protein, 16 aa, Homo sapiens
MRGKHVCLLLLLLGRF

SEQ ID NO: 5930 - protein, 28 aa, Homo sapiens
MMELVLMASEVSGQSAQILASFLALVSL

SEQ ID NO: 5931 - protein, 15 aa, Homo sapiens
MHRAFLVTNRRWALR

SEQ ID NO: 5932 - protein, 22 aa, Homo sapiens
MSLILFLLINIRWDLSLVLSQR

SEQ ID NO: 5933 - protein, 39 aa, Homo sapiens
MKKIVFPFPGSFNSLFLRLFFSSLLSYSIQTSPCLILKR

SEQ ID NO: 5934 - protein, 44 aa, Homo sapiens
MRRQPLALRSLLCTLPLVPGVAIYLVGPRPLSSRKASVLSSALC

SEQ ID NO: 5935 - protein, 38 aa, Homo sapiens
MPAATWHPLSCLLSFLVCAVVGCISPFLHCNKGIPEIG

SEQ ID NO: 5936 - protein, 27 aa, Homo sapiens
MFPMLFCVLGHLMHFSRASCFPSVRIP

SEQ ID NO: 5937 - protein, 20 aa, Homo sapiens
GTYPLFLECLSLSCLLSGPQ

SEQ ID NO: 5938 - protein, 32 aa, Homo sapiens
MFLLFLRSLPYILCIVKPFLKSNDLGKPTLVC

SEQ ID NO: 5939 - protein, 14 aa, Homo sapiens
MFEGPGRAVACLCL

SEQ ID NO: 5940 - protein, 20 aa, Homo sapiens
MCWLAAKNLLECKYASLHHL

SEQ ID NO: 5941 - protein, 39 aa, Homo sapiens
MWLKIGFLSIFSLVLFYKTSLSTYHVPYSLVGPEDKEMY

SEQ ID NO: 5942 - protein, 12 aa, Homo sapiens
MAASMHQCFPLT

SEQ ID NO: 5943 - protein, 37 aa, Homo sapiens
MMCFLGAGCIEFKTWTMAWIAWVQILPLLYHFRQAGP

SEQ ID NO: 5944 - protein, 23 aa, Homo sapiens
MEVGVSLLCRIWDWANVCVASLN

SEQ ID NO: 5945 - protein, 7 aa, Homo sapiens
SFKLLIT

SEQ ID NO: 5946 - protein, 72 aa, Homo sapiens
  SITE (43): Xaa equals any amino acid
MPACGSLPPRAHQPWCPAGLLQSLVLEQLLEFSAASSPQPSRXSELLPGQHLLGPVLRPHGAGLMWELILAG

SEQ ID NO: 5947 - protein, 21 aa, Homo sapiens
MAFLKGWLPFCWSQRSIHSYL

SEQ ID NO: 5948 - protein, 80 aa, Homo sapiens
IGHIMLLVFPKCLVIFYCSFNYRLHFFVCLFLLSSQMLPNMAASNPEFNPGTILQTAQFSSEWAICIPTHQSYYLKNYIF

SEQ ID NO: 5949 - protein, 67 aa, Homo sapiens
PFNTILLFCLYFLLTVHIINYVIYFFIAGSFNPVLCLGDAPIQLHVTVACSFPVSCSVPSCEFITVY

SEQ ID NO: 5950 - protein, 43 aa, Homo sapiens
MCVCVYIYIYVYIYVYICIYVYINQNEKPFWILRATKFREVIS

SEQ ID NO: 5951 - protein, 45 aa, Homo sapiens
MFYNFLLIFIFLVCQSSPLTSHIYLCCILAWCLAWRRHWNIGKNE

SEQ ID NO: 5952 - protein, 23 aa, Homo sapiens
  SITE (4): Xaa equals any amino acid
  SITE (15): Xaa equals any amino acid
GPGXEVIESWEPSLXLCCSGGGE

SEQ ID NO: 5953 - protein, 92 aa, Homo sapiens
MPFQFPKKARLVPLLGLCLEYSQTLSRAPAWMSVSRGPPHSTWIKAGLPGALHHTPFPPSACLARPARSFHDGRAWPLLHAMQAWPLPTTGP

SEQ ID NO: 5954 - protein, 27 aa, Homo sapiens
MFYWQRLGLALLASVLGFFLCTADWLS

SEQ ID NO: 5955 - protein, 33 aa, Homo sapiens
MLTTYWVLCSLPIGYCAHYLLGTLVTASYNIPM

SEQ ID NO: 5956 - protein, 190 aa, Homo sapiens
IALRLTLLPASSAALHLRRSPVCLQLLPRQLIKQPVRLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCTGGGGPLPHFSLSTLYAGPAG

SEQ ID NO: 5957 - protein, 194 aa, Homo sapiens
MCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNRSDVPFWAIKNSWGTDWGEKGYYYLHRGSGACGVNTMASSAVVD

SEQ ID NO: 5958 - protein, 232 aa, Homo sapiens [sequence omitted]

SEQ ID NO: 5959 - protein, 75 aa, Homo sapiens
WVSLCTLASVLLGAGAVSHARACEGTTGVNESPMMTWGEVENTPLRVEGSETPYVDRTPGPAFKILEPGRRNGWV

SEQ ID NO: 5960 - protein, 49 aa, Homo sapiens
MSMFWLKKLLESGLFCAMCSPRASTKKGFWCRPKTTIIIIDYSSPRQCL

SEQ ID NO: 5961 - protein, 93 aa, Homo sapiens
MLCAAAIATVASSCREGLVPCAAQQLLEVKLEQVLLLPQPHVPGKGAASSPSGSSGPTCGSCCRPPLPRAPPVGPSYTRCSPGRCTSRPRSRS

SEQ ID NO: 5962 - protein, 176 aa, Homo sapiens
MAWSSPAGLLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILVPPWGLPPVSARPPFSGPFTRRPGLWGSPTSWP

SEQ ID NO: 5963 - protein, 8 aa, Homo sapiens
MSEGLLCL

SEQ ID NO: 5964 - protein, 170 aa, Homo sapiens
MILTMLLMLKLCTEVRVANELNARRRSFTDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 5965 - protein, 13 aa, Homo sapiens
MASLCSCLTALMC

SEQ ID NO: 5966 - protein, 13 aa, Homo sapiens
MASLCSCLTALMC

SEQ ID NO: 5967 - protein, 152 aa, Homo sapiens
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLERYIAGLTTL

SEQ ID NO: 5968 - protein, 75 aa, Homo sapiens [sequence omitted]

SEQ ID NO: 5969 - protein, 35 aa, Homo sapiens [sequence omitted]

SEQ ID NO: 5970 - protein, 314 aa, Homo sapiens
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 5971 - protein, 174 aa, Homo sapiens
MTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRSFGLGDSCARKSARANGNGSG

SEQ ID NO: 5972 - protein, 170 aa, Homo sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTVSYSSRSQKSEICISGLKSRHQQNCSFWRF

SEQ ID NO: 5973 - protein, 85 aa, Homo sapiens
  SITE (35): Xaa equals any amino acid
  SITE (74): Xaa equals any amino acid
  SITE (76): Xaa equals any amino acid
  SITE (77): Xaa equals any amino acid
  SITE (83): Xaa equals any amino acid
MLWTTLTGVSLALFPVAQAPTALVALAVAYGFTSXALAPLAFSVLPELIGTRRIYCGLGLLQMIESIGGLLGPXLXXKWNGVXRG

SEQ ID NO: 5974 - protein, 303 aa, Homo sapiens
MAWCGRLLLSPSPTASPAARLLRTLAETPPADTFLLGNWCWMCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLPAPRLPHAPLSFRRPRRPSPARSAPAWCPGKRCRCAPPPATGAEVVLSLAACRGVPGPTAEGAGKGDSAKTALLKKKKKK

SEQ ID NO: 5975 - protein, 187 aa, Homo sapiens [sequence omitted]

SEQ ID NO: 5976 - protein, 187 aa, Homo sapiens [sequence omitted]

SEQ ID NO: 5977 - protein, 187 aa, Homo sapiens [sequence omitted]

SEQ ID NO: 5978 - protein, 187 aa, Homo sapiens [sequence omitted]

SEQ ID NO: 5979 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 5980 - protein, 240 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 5981 - protein, 31 aa, Homo sapiens
MCICVLILICIFTDFIISYVLNFYLWRKHTT

SEQ ID NO: 5982 - protein, 23 aa, Homo sapiens
MHLIIFFIILCTNSACNNQFTWK

SEQ ID NO: 5983 - protein, 51 aa, Homo sapiens
MTLLLWKFNLFIVFWALWVVRAGLWVLGNSSGSQHSKAKLTSSSHTLQEKH

SEQ ID NO: 5984 - protein, 51 aa, Homo sapiens; identical to SEQ ID NO: 5983

SEQ ID NO: 5985 - protein, 51 aa, Homo sapiens; identical to SEQ ID NO: 5983

SEQ ID NO: 5986 - protein, 51 aa, Homo sapiens; identical to SEQ ID NO: 5983

SEQ ID NO: 5987 - protein, 28 aa, Homo sapiens
HEPRVPWSDKLGNAACCTFLSKIHVQRI

SEQ ID NO: 5988 - protein, 15 aa, Homo sapiens
MREVLLFFLFYTRGH

SEQ ID NO: 5989 - protein, 51 aa, Homo sapiens
MPSEAFVIVIQPLIVSTSTDHFVTTSCGSYYSQTVSLKRKPLFYKSTLQVF

SEQ ID NO: 5990 - protein, 34 aa, Homo sapiens
MLMICLLSGRAFAYFFSNYFTSTLILLSQFSYQH

SEQ ID NO: 5991 - protein, 118 aa, Homo sapiens
VARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKTCWWGPTL

SEQ ID NO: 5992 - protein, 4 aa, Homo sapiens
CTLL

SEQ ID NO: 5993 - protein, 36 aa, Homo sapiens
HKFSECTVYFGFRRAVYLSLLLLASSALQLPLERAF

SEQ ID NO: 5994 - protein, 62 aa, Homo sapiens
KCFHLLWSLVTSAQRPSDGYFFEAFIYIILFCTMFFLNVQILYSSEKNTVFVDNHSYYTVLR

SEQ ID NO: 5995 - protein, 14 aa, Homo sapiens
MSTFLWDIQTTYCF

SEQ ID NO: 5996 - protein, 16 aa, Homo sapiens
LTLPYLFLGGGWRGGV

SEQ ID NO: 5997 - protein, 31 aa, Homo sapiens
MVCWLLPLWVTVLSFPVGRDVAALLIFTSSY

SEQ ID NO: 5998 - protein, 19 aa, Homo sapiens
LSLLHPLSVPPGSLEQDGV

SEQ ID NO: 5999 - protein, 6 aa, Homo sapiens
GDVWLL

SEQ ID NO: 6000 - protein, 24 aa, Homo sapiens
MCWPWGGPPLPSLPTSLRWMSLCY

SEQ ID NO: 6001 - protein, 24 aa, Homo sapiens
MCWPWGGPPLPSLPTSLRWMSLCY

SEQ ID NO: 6002 - protein, 46 aa, Homo sapiens
NTFWHGSSCLSICQFSCEDSVYRLYTAHVERGQWVLYLKYVLPFCC

SEQ ID NO: 6003 - protein, 43 aa, Homo sapiens
MLLPILLYSFLYPTIVSRNYFKLIRSCMLFLKKKKKKERKISV

SEQ ID NO: 6004 - protein, 23 aa, Homo sapiens
FNSLLLLMLPCYLCCHYPLFFPS

SEQ ID NO: 6005 - protein, 40 aa, Homo sapiens
MSRGCLSLLLIIIHFLGSHCPHLFSLELRFIFILQTGKTE

SEQ ID NO: 6006 - protein, 14 aa, Homo sapiens
FCTTFNFLFVFCLR

SEQ ID NO: 6007 - protein, 37 aa, Homo sapiens
MPSQTARPGLQLFTTPCILQLLWCFAPPVVGNFCTTL

SEQ ID NO: 6008 - protein, 15 aa, Homo sapiens
MAGSHAVWAWHCPGL

SEQ ID NO: 6009 - protein, 31 aa, Homo sapiens
MLSNKIFPVYFQLVKSFIFVVGCCLFTLGGN

SEQ ID NO: 6010 - protein, 71 aa, Homo sapiens
MFLPLSVDYHYRILGFFLSFCSALHPLVVCFFCWALLISLPLVSSPTAYVLKCVFLKYCFPLVTFLLEDFQ

SEQ ID NO: 6011 - protein, 34 aa, Homo sapiens
MSPVLWWSWNLILFMNFQSLEKSMVWIWEVGLAD

SEQ ID NO: 6012 - protein, 37 aa, Homo sapiens
MGLLLFGGIFLLTVIMKVITMRDSDLFLKFGGGISPH

SEQ ID NO: 6013 - protein, 14 aa, Homo sapiens
MFLYRNKFIPVTLW

SEQ ID NO: 6014 - protein, 36 aa, Homo sapiens
MYWVIAGTTFTSLLCLIQFISLVCALLKYLCLNFCI

SEQ ID NO: 6015 - protein, 35 aa, Homo sapiens; identical to SEQ ID NO: 5601

SEQ ID NO: 6016 - protein, 23 aa, Homo sapiens
HLPICFLFSASPGASGHFLLPFL

SEQ ID NO: 6017 - protein, 30 aa, Homo sapiens
MSIFVQVFVWKYVFVSLRYIGKELQNQLCA

SEQ ID NO: 6018 - protein, 47 aa, Homo sapiens
MKCNSCSLGPFHSLFLGPACGLVGTLESRHSRGRGRAAFLAGHSRAL

SEQ ID NO: 6019 - protein, 134 aa, Homo sapiens
MGPEDLGERDNSFHCIFVTATFLETFFWKRLPWLLVQMGVSQGAGLCPWNLSLATCFRDWSGGTEGLGFSLWGLCCLWGYTEGKAGQWGLCCGEWQLAQSRDKILELGRSPAFGVAFGAPGTAGRGAQYLLSSA

SEQ ID NO: 6020 - protein, 48 aa, Homo sapiens [sequence omitted]

SEQ ID NO: 6021 - protein, 33 aa, Homo sapiens
MCLIFSICFLCIHIGFCFVFNLLIMGLNFQIYF

SEQ ID NO: 6022 - protein, 53 aa, Homo sapiens
KEAGTWLVFWIRLDFSTGQDSLFLGRAECHVDSSDRITAVPLSLGFESLGLGH

SEQ ID NO: 6023 - protein, 33 aa, Homo sapiens
MCPYCPTSCALLVMCFLLISLSCLVASSLLLKV

SEQ ID NO: 6024 - protein, 33 aa, Homo sapiens
MCLNLTVISALLWWSGTKVAVAPRYAYTVKNNL

SEQ ID NO: 6025 - protein, 53 aa, Homo sapiens
MKGHFGKGLDELVAFNLCLHLPLSATLGRPGGASEDHRPTGLAIMTPLEVSSS

SEQ ID NO: 6026 - protein, 40 aa, Homo sapiens
EVKCIYIFLWLLMLLVLHLRIHCQIQGHEDLLLCFLLRIL

SEQ ID NO: 6027 - protein, 60 aa, Homo sapiens
  SITE (10): Xaa equals any amino acid
  SITE (42): Xaa equals any amino acid
MFFPCLPTLXLRILHSGWVGLFLLISSRAPSSSLAWKHGPGXLWWPRRPLRSCTGLASCG

SEQ ID NO: 6028 - protein, 31 aa, Homo sapiens
MMKMKMKMQWMLMVVMMMIKGVMMNTVMMMT

SEQ ID NO: 6029 - protein, 47 aa, Homo sapiens
MRIYLMLVLVYCELNITALEPKRRCLRHGLLLLCSFQGAPVIPAVST

SEQ ID NO: 6030 - protein, 13 aa, Homo sapiens
MASGLNSGAFGVV

SEQ ID NO: 6031 - protein, 17 aa, Homo sapiens
MLLLCVFLFVFMVFGAI

SEQ ID NO: 6032 - protein, 50 aa, Homo sapiens
MGAWPPCPARSSRRRSLAAWCVACCWSSRWAAPSSSTHCARRNTGPSRPR

SEQ ID NO: 6033 - protein, 49 aa, Homo sapiens
MLYLPALWFHHVQQSQGCIAVNFWYDMEYDLKYSYFQLLDSLTKASGLD

SEQ ID NO: 6034 - protein, 21 aa, Homo sapiens
MTAEAMFSFLIFICLLILFSK

SEQ ID NO: 6035 - protein, 35 aa, Homo sapiens
MFFEIHPLLTFCTICFIICTLCVGGLCVQYAIGFS

SEQ ID NO: 6036 - protein, 45 aa, Homo sapiens
MLLLSFHSLLYFGDLFILLCVHLILQCVSTTFNLFTYRTMQEFLW

SEQ ID NO: 6037 - protein, 15 aa, Homo sapiens
MCLCNDCLFWFTMFL

SEQ ID NO: 6038 - protein, 37 aa, Homo sapiens
MITDVQLAIFANMLGVSLFLLVVLYHYVAVNNPKKQE

SEQ ID NO: 6039 - protein, 99 aa, Homo sapiens
FHPFTFYVFVCLCLKCIYHRQHIVGSCFFIQFDSLCLLIDVWVHLHLMLLSVWLGLSLSSCYLFCICSMYALFPFLPFSAFFWITVFFNDSIVFSSLIY

SEQ ID NO: 6040 - protein, 234 aa, Homo sapiens
KLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWEERPSSHDFMI

SEQ ID NO: 6041 - protein, 244 aa, Homo sapiens
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRLW

SEQ ID NO: 6042 - protein, 68 aa, Homo sapiens
MFATQGHSCPQGLSDFLLLALLMSLHHPPSPLLQRGNNKGTEDSCIWEKSCQIQKFAIMYFYVFMPCD

SEQ ID NO: 6043 - protein, 57 aa, Homo sapiens
EWWPFCPPPIPVSTFIKLLCCLHFLTTSLAAYISFFPSGVSPSLLTGSSPLHLRSGL

SEQ ID NO: 6044 - protein, 7 aa, Homo sapiens
IIGTFYQ

SEQ ID NO: 6045 - protein, 40 aa, Homo sapiens
MTGHSPSPIYLVLAWGVTAAATTLTGPVLSRYNLATPWNS

SEQ ID NO: 6046 - protein, 28 aa, Homo sapiens
MPNCLHIILGSFLLIIFTVCMFIGKGLL

SEQ ID NO: 6047 - protein, 27 aa, Homo sapiens
MLLLFWTFALDVVPTEWLAGRREILFR

SEQ ID NO: 6048 - protein, 47 aa, Homo sapiens
MYSKSSANISQGMLDILLWIDLAHDDLLGSPSPVILRSHAHSGILTV

SEQ ID NO: 6049 - protein, 32 aa, Homo sapiens
MFSRFIHLFGVLNLMWLSLVSCQCLFAFCFQR

SEQ ID NO: 6050 - protein, 76 aa, Homo sapiens [sequence omitted]

SEQ ID NO: 6051 - protein, 28 aa, Homo sapiens
MGRRIRWHSWMTLWIFLMKSALVWMIWL

SEQ ID NO: 6052 - protein, 20 aa, Homo sapiens
MFQAPCFLMYLVFFPHFERI

SEQ ID NO: 6053 - protein, 54 aa, Homo sapiens
MVRAQMSPQSPALAEWILLLALLLRLRWRQLWNKMFLAPKKKKKKKKKKKKKKK

SEQ ID NO: 6054 - protein, 16 aa, Homo sapiens
MSSWLLVYIGWLLSSL

SEQ ID NO: 6055 - protein, 318 aa, Homo sapiens
  SITE (192): Xaa equals any amino acid
MKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLXKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 6056 - protein, 24 aa, Homo sapiens
MFLVLVICYYLLLSSRGPDWPWHN

SEQ ID NO: 6057 - protein, 33 aa, Homo sapiens
MLRNTALWYHLLTDLLLIYLIGRVVSISFYFYH

SEQ ID NO: 6058 - protein, 57 aa, Homo sapiens
EPLADFCFLYRLLCRLTSRLYPCLCERGCVVGTGTILTQKLATSHCLAQMWIIVITN

SEQ ID NO: 6059 - protein, 32 aa, Homo sapiens
MSFSCACAGSASVFFLFCVAQPLPGTRQPWQE

SEQ ID NO: 6060 - protein, 46 aa, Homo sapiens
MTKKPQSIACSTLSLWCVCLASIIHEVNLEGQTGNNMSWYILPGNT

SEQ ID NO: 6061 - protein, 116 aa, Homo sapiens
  SITE (14): Xaa equals any amino acid
MFSVFFLLLLLFLXFILLLLLPPSSSVLLLFLFLFLLLFSFSSFFSFFFFLGQGLILLPRLEYTGTIIARCRLKLLTSSNPPFLASQSAGIRGMSHCTWPVFHYSYICYGNVTSDL

SEQ ID NO: 6062 - protein, 39 aa, Homo sapiens
  SITE (22): Xaa equals any amino acid
MCIEACFTPICSFCCVSFSGLXHSLFLLFIKNRISKDYE

SEQ ID NO: 6063 - protein, 30 aa, Homo sapiens
MSEVKILRFVLITFVFCKHSDPPISALSLT

SEQ ID NO: 6064 - protein, 32 aa, Homo sapiens
METAICLVLFPQLLLLVVHISSSALAHGTLIN

SEQ ID NO: 6065 - protein, 50 aa, Homo sapiens
MQWPRAEGLIHGLFQGVLLAGWTWECAVGQGAAGVLPPPSTNLAPWGPAS

SEQ ID NO: 6066 - protein, 41 aa, Homo sapiens
DPSFRSLLPLFLLFRGCVITETWNAEKCYHRNLECRKIFAF

SEQ ID NO: 6067 - protein, 26 aa, Homo sapiens
MLLGVFLTGLFLPILMAIFLLKCNSF

SEQ ID NO: 6068 - protein, 16 aa, Homo sapiens
MILIVPYILKVVWFYF

SEQ ID NO: 6069 - protein, 34 aa, Homo sapiens
MFMFLLLVGLCLFPLNITKKNKKKSCINICCISK

SEQ ID NO: 6070 - protein, 15 aa, Homo sapiens
NVCFSCLLKLFWGSQ

SEQ ID NO: 6071 - protein, 14 aa, Homo sapiens
AALWQSLLFCFVCF

SEQ ID NO: 6072 - protein, 64 aa, Homo sapiens
MVLLQTVVWLSSHVLWLPQNRAQAARGHLHVPLLAVPATSKLCHRLNSSFRGPGWHPGDLPLLF

SEQ ID NO: 6073 - protein, 42 aa, Homo sapiens
LWRLAVLKLICGFINTLLIIFPGEIFIKCRPAKAILKRRRRH

SEQ ID NO: 6074 - protein, 45 aa, Homo sapiens
MLFVLYMSLLSKAVSSMRTGTILINCVFLAPHTSAWNIATINKCL

SEQ ID NO: 6075 - protein, 27 aa, Homo sapiens
SYISDTRSHFLFLYFIHPFIQQIFAEH

SEQ ID NO: 6076 - protein, 31 aa, Homo sapiens
MLLHLCLSLPSSVWFLGVLLLSCVNTALQYH

SEQ ID NO: 6077 - protein, 56 aa, Homo sapiens
MARACVFQLSLWRKLPVGINLSPAILSLSLGCLGLGFLLLLERMTTDSGIRQRRQT

SEQ ID NO: 6078 - protein, 70 aa, Homo sapiens
MQSLPSASTFSASSACGAAMRPARGSAPSATRPLVPTTSIVSTSAEPETQGTLEHHGPWGLCPISSPPQV

SEQ ID NO: 6079 - protein, 34 aa, Homo sapiens
MASRVLAALIVASVVGLAELYVMVRAMEGELGEL

SEQ ID NO: 6080 - protein, 27 aa, Homo sapiens
MAFLGLTLCTLHLGIQASTVPLGLPSP

SEQ ID NO: 6081 - protein, 43 aa, Homo sapiens
MVVEELANIKLAPEIQTCVYCSGSMELVTMGKRQRLELCKVME

SEQ ID NO: 6082 - protein, 81 aa, Homo sapiens
MVARVWSLMRFLIKGSVPGGAVYLVYDQELLGPSDKSQAALQKAGEVVPPAMLPVQPVRVSADRPADTPAPSPSKDLLSHP

SEQ ID NO: 6083 - protein, 15 aa, Homo sapiens
MYILLFLLAIFLRLY

SEQ ID NO: 6084 - protein, 32 aa, Homo sapiens
MLPSTRVFTLRYCWSCQLSRDMISLFRQPCSF

SEQ ID NO: 6085 - protein, 32 aa, Homo sapiens
MAKSSGHNSLVAFVVVVVVLFFVCFETMSPKQ

SEQ ID NO: 6086 - protein, 4 aa, Homo sapiens
MVKP

SEQ ID NO: 6087 - protein, 31 aa, Homo sapiens
MPLVPLLLSCPPTWLARFGVSLPCSGIPVLA

SEQ ID NO: 6088 - protein, 83 aa, Homo sapiens
MYEQAAAGHGPISPFSLCVSLGIHPANQGRPGVWALGTNGAHILEWQILGDALPVPAGPVPPTQSSPQTWCNFTRAIPFPRLP

SEQ ID NO: 6089 - protein, 12 aa, Homo sapiens
WWGRVWPVNPDH

SEQ ID NO: 6090 - protein, 9 aa, Homo sapiens
MLLLVFLDC

SEQ ID NO: 6091 - protein, 73 aa, Homo sapiens
MNITRKLWSRTFNCSVPCSDTVPVIAVSVFILFLPVVFYLSSFLHSEQKKRKLILPKRLKSSTSFANIQENSN

SEQ ID NO: 6092 - protein, 9 aa, Homo sapiens
MKSPEYHYG

SEQ ID NO: 6093 - protein, 129 aa, Homo sapiens [sequence omitted]

SEQ ID NO: 6094 - protein, 61 aa, Homo sapiens
MCLLLLWLTTFQRTSGALRRGGLSSPAWAMRSPSVYSTQTPSPMMSTGTLRGLSGAMCNLS

SEQ ID NO: 6095 - protein, 12 aa, Homo sapiens
LASTANFWVVIT

SEQ ID NO: 6096 - protein, 46 aa, Homo sapiens
MAAGTFLYITFLEILPQELASSEQRILKVILLLAGFALSWPVFIQI

SEQ ID NO: 6097 - protein, 52 aa, Homo sapiens
MVTLSSLILEMWYCFWLNILVGRVSSRGFHLALTIKMTLISWVRKPIWELCQ

SEQ ID NO: 6098 - protein, 46 aa, Homo sapiens
MKSQCYSPSYFAFFCLVFFQITSASSQTLRGHVLCRTTLRDSSAYC

SEQ ID NO: 6099 - protein, 38 aa, Homo sapiens
MFTCTAGLSCLFQFCFTCGVFTDFKKECMHGVEQDTVS

SEQ ID NO: 6100 - protein, 55 aa, Homo sapiens
MPSEIIYLLSLLYTSVCLQQPPQPRWVCFCFLGWGAGTGGGRRAGFRSLLAEPFV

SEQ ID NO: 6101 - protein, 80 aa, Homo sapiens
  SITE (80): Xaa equals any amino acid
MLVLGLTKFAVGIVLILLVRQLVQNLSLQVLYSWFKVVTRNKEARRRLEIEVPYKFVTYTSVGICATTFVPMLHRFLGLX

SEQ ID NO: 6102 - protein, 50 aa, Homo sapiens
MWQSCLCRFVLLIEGLEPGALPAFPGSPSSRHGLTVSHVEGLGSLMKCGL

SEQ ID NO: 6103 - protein, 13 aa, Homo sapiens
MWCPAFGRVFCSR

SEQ ID NO: 6104 - protein, 35 aa, Homo sapiens
MPLLQWLALLWPLLTTEAPSGGCSQPGPGPRSSLT

SEQ ID NO: 6105 - protein, 91 aa, Homo sapiens
FLIIIISATVMFLHVSERHCPCLRLEVLSAKVFFSCIVRSIHPLCALSAFERLGCSQAAVLRDLKRDLVSLGAESIYLGTLFQERPCLHFH

SEQ ID NO: 6106 - protein, 14 aa, Homo sapiens
MLHSRLYSLVGWLL

SEQ ID NO: 6107 - protein, 26 aa, Homo sapiens
MRTYLWILTCIRTSVQGPLMTMACPG

SEQ ID NO: 6108 - protein, 47 aa, Homo sapiens
MRNTAYLPISLLLVGSGLCLAQRITLFTSGTFRRKRLYRNYKATQMS

SEQ ID NO: 6109 - protein, 92 aa, Homo sapiens
  SITE (7): Xaa equals any amino acid
  SITE (30): Xaa equals any amino acid
MASQTSXIIWPLATLPHPISSFALYSSYTXRGVPKTSRWVRPQDLHMCCSLYLHRSFLFSCLLNSYLPSGLISTFSPLLVCCSYLRSNSREM

SEQ ID NO: 6110 - protein, 35 aa, Homo sapiens
MCLLWSWLWVQPTLRCVFIFHYKNYKQLFISRQEF

SEQ ID NO: 6111 - protein, 39 aa, Homo sapiens
MKKLMPREFRGFAFRCLTCRYLILLKISLDIVSVRCTDL

SEQ ID NO: 6112 - protein, 39 aa, Homo sapiens
MVKNALWNTLHSFLSRLRFTITIWKFLGCFQCLGGAQKC

SEQ ID NO: 6113 - protein, 38 aa, Homo sapiens
MGRFVLNVIFILYPVLSWEHKAKRPSILHYLLKTCPQA

SEQ ID NO: 6114 - protein, 32 aa, Homo sapiens
MLFLFWFCQFATREFIFEQLPMAMGLGLYSRA

SEQ ID NO: 6115 - protein, 73 aa, Homo sapiens [sequence omitted]

SEQ ID NO: 6116 - protein, 13 aa, Homo sapiens
MCSCSWASSCTVW

SEQ ID NO: 6117 - protein, 328 aa, Homo sapiens
MSSLKVAATMIILKFSMAPTAVPLSLLEFVMGPEAPSLLPPTSCPFASSVTTASQGRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPLPAATEAVC

SEQ ID NO: 6118 - protein, 31 aa, Homo sapiens
MQGQQTFPVKGQIGSIFGFLGCLLLLLLLWE

SEQ ID NO: 6119 - protein, 16 aa, Homo sapiens
MPFYCLSLLLLFFKLS

SEQ ID NO: 6120 - protein, 109 aa, Homo sapiens
MGSTQVSFFFLFSFLLPSFLHSSLPPNLPPSLPSLLPSFLNLGPPKSCWDYKAMSHRGPAYIPLFLIISFFIFSILLTFILTFLSAMKTAPNLPHLRLAIFDSLMGEVQ

SEQ ID NO: 6121 - protein, 31 aa, Homo sapiens
MYVFKTQLVTCDCEIDNTWMHSCSHRIGDML

SEQ ID NO: 6122 - protein, 25 aa, Homo sapiens
DSIPAAGELGIVFVAFFILDEVQKF

SEQ ID NO: 6123 - protein, 30 aa, Homo sapiens
MLTLFFKLLLISAYYEEHECTVHTNNLMSH

SEQ ID NO: 6124 - protein, 20 aa, Homo sapiens
MTKPKPLLLSYIFCFHVLSF

SEQ ID NO: 6125 - protein, 50 aa, Homo sapiens
MPTHPTRLVLLLPIDGEHLAGSLLISTVLLGPGTLQLPCKCSAQRLPNTS

SEQ ID NO: 6126 - protein, 32 aa, Homo sapiens
MSLLLINRMWPWVSTEPLLASASSFMWEFSST

SEQ ID NO: 6127 - protein, 6 aa, Homo sapiens
MLCHFF

SEQ ID NO: 6128 - protein, 232 aa, Homo sapiens
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 6129 - protein, 232 aa, Homo sapiens; identical to SEQ ID NO: 6128

SEQ ID NO: 6130 - protein, 36 aa, Homo sapiens
MLLLHLTLGLLPQAVQSLNFLFCFIHLTLQSLHPQA

SEQ ID NO: 6131 - protein, 28 aa, Homo sapiens
MLFCVLIGWISVCLILGILGEKKMVFSF

SEQ ID NO: 6132 - protein, 23 aa, Homo sapiens
KAAVMWGHWALLFFSTMCMHFGA

SEQ ID NO: 6133 - protein, 9 aa, Homo sapiens
MVLSPLFSA

SEQ ID NO: 6134 - protein, 224 aa, Homo sapiens
  SITE (137): Xaa equals any amino acid
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKXVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 6135 - protein, 13 aa, Homo sapiens
MEGTGSGNGRYCM

SEQ ID NO: 6136 - protein, 10 aa, Homo sapiens
MFVGCINVFF

SEQ ID NO: 6137 - protein, 486 aa, Homo sapiens
  SITE (200): Xaa equals any amino acid
RPPRVRATKMAAPILRSFSWGRWSGTLNLSVLLPLGLRKAHSGAQGLLAAQKARGLFKDFFPETGTKIELPELFDRGTASFPQTIYCGFDPTADSLHVGHLLALLGLFHLQRAGHNVIALVGGATARLGDPSGRTKEREALETERVRANARALRLGLEALAANHQQLFTDGRSWGSFTVLDNSAWYQKQHLVDFLAAVGXHFRMGTLLSRQSVQLRLKSPEGMSLAEFFYQVLQAYDFYYLFQRYGCRVQLGGSDQLGNIMSGYEFINKLTGEDVFGITVPLITSTTGAKLGKSAGNAVWLNRDKTSPFELYQFFVRQPDDSVERYLKLFTFLPLPEIDHIMQLHVKEPERRGPQKRLAAEVTKLVHGREGLDSAKRCTQALYHSSIDALEVMSDQELKELFKEAPFSEFFLDPGTSVLDTCRKANAIPDGPRGYRMITEGGVSINHQQVTNPESVLIVGQHILKNGLSLLKIGKRNFYIIKWLQL

SEQ ID NO: 6138 - protein, 388 aa, Homo sapiens
  SITE (102): Xaa equals any amino acid
  SITE (114): Xaa equals any amino acid
  SITE (121): Xaa equals any amino acid
GHLLALLGLFHLQRAGHNVIALVGGATARLGDPSGRTKEREALETERVRANARALRLGLEALAANHQQLFTDGRSWGSFTVLDNSAWYQKQHLVDFLAAVGXHFRMGTLLSRQXVQLRLKXPEGMSLAEFFYQVLQAYDFYYLFQRYGCRVQLGGSDQLGNIMSGYEFINKLTGEDVFGITVPLITSTTGAKLGKSAGNAVWLNRDKTSPFELYQFFVRQPDDSVERYLKLFTFLPLPEIDHIMQLHVKEPERRGPQKRLAAEVTKLVHGREGLDSAKRCTQALYHSSIDALEVMSDQELKELFKEAPFSEFFLDPGTSVLDTCRKANAIPDGPRGYRMITEGGVSINHQQVTNPESVLIVGQHILKNGLSLLKIGKRNFYIIKWLQL

SEQ ID NO: 6139 - protein, 510 aa, Homo sapiens
QAFTGYKRYQCVYSLAEIFKVLASFYVILVILYGLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 6140 - protein, 16 aa, Homo sapiens
MLLLAFVTSFFYLLYS

SEQ ID NO: 6141 - protein, 37 aa, Homo sapiens
MYLPVCYILLLIHPSRMQSWLTYMIRYNNRMSWKYRS

SEQ ID NO: 6142 - protein, 32 aa, Homo sapiens
MLSSSRSLSFIMSVLILIPGARSCGGPLVAQD

SEQ ID NO: 6143 - protein, 34 aa, Homo sapiens
MEEWGNGSGIGREGLLLIVLKAIGKSSLYVAVNL

SEQ ID NO: 6144 - protein, 22 aa, Homo sapiens
MEVMDILMALATDTVIPSLMVL

SEQ ID NO: 6145 - protein, 72 aa, Homo sapiens [sequence omitted]

SEQ ID NO: 6146 - protein, 487 aa, Homo sapiens
MFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRSQMLPAPTCWGCSQASLQTPRSPPLPPRNTSGAPVQPAWSAAARAGSLESLRPSPVRSGFR

SEQ ID NO: 6147 - protein, 33 aa, Homo sapiens
MPIHRFSVLALLVMPPLMNGRQVQVKEWCFWNP

SEQ ID NO: 6148 - protein, 41 aa, Homo sapiens
VGGWSWVWSPWLAAFVCARAARDPGPSVRWRPPFARSWRRP

SEQ ID NO: 6149 - protein, 26 aa, Homo sapiens
DVVCLFLFVYVLIKHVDYFYKTKGKM

SEQ ID NO: 6150 - protein, 26 aa, Homo sapiens
MGTCTWALSGPPSSADSASRLFSPPR

SEQ ID NO: 6151 - protein, 52 aa, Homo sapiens
MIIYVENPKELTTKLLKVFLVLISQLARLKDTRLIHKSQSLFYMASTNETRS

SEQ ID NO: 6152 - protein, 19 aa, Homo sapiens
MWSLKYSSYKIFVLLIFAG

SEQ ID NO: 6153 - protein, 69 aa, Homo sapiens
MDGGQAVPTLLGGAGLGGVFHCVPFSPRPVPRVWGALLRTPPRAPSSRLWTPRQERPSAAKRNKILASR

SEQ ID NO: 6154 - protein, 25 aa, Homo sapiens
MIVLICVIVFIIILFIVLFATGAFS

SEQ ID NO: 6155 - protein, 38 aa, Homo sapiens
MKAVIHQKYGFLHLLFLLFLSLHRISSATFTLNTKSSS

SEQ ID NO: 6156 - protein, 22 aa, Homo sapiens
FLFFGVLPVCKGEFVHWERPGS

SEQ ID NO: 6157 - protein, 92 aa, Homo sapiens [sequence omitted]

SEQ ID NO: 6158 - protein, 87 aa, Homo sapiens
  SITE (69): Xaa equals any amino acid
MNGRHRFCFLRCCGCVFSERALKEIKAEVCHTCGAAFQEDDVIVLNGTKEDVDVLKTRMEERRLRAKLXKENKETQGSRVCFKTRCQ

SEQ ID NO: 6159 - protein, 25 aa, Homo sapiens
MCWVLFFSPGLLFLSLLCPDFFSFF

SEQ ID NO: 6160 - protein, 31 aa, Homo sapiens
MRCFLFLLGGARFICQLSTVRKHFGSPLSDI

SEQ ID NO: 6161 - protein, 15 aa, Homo sapiens
MPFNKRSHSPAALCP

SEQ ID NO: 6162 - protein, 62 aa, Homo sapiens
RRAVRWELLVLLLLLLPTLRRPGPRCRPGPGCRLRPRRPRPRVRPSQDAAPGRVSTSWPHLP

SEQ ID NO: 6163 - protein, 22 aa, Homo sapiens
MIQWFHKGLFPFGSALLLVAAM

SEQ ID NO: 6164 - protein, 405 aa, Homo sapiens
MGFCLSSLLAWCVDCFFSLCSFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 6165 - protein, 17 aa, Homo sapiens
MSSLLLIIILALSLAYE

SEQ ID NO: 6166 - protein, 51 aa, Homo sapiens
  SITE (43): Xaa equals any amino acid
MRAFIWTCGTWTLWSLSDRSLGSSRICMGFAGSLKRPGRTKAXTTFWGTWF

SEQ ID NO: 6167 - protein, 60 aa, Homo sapiens
MSPTGLLVVFAPVVLGLKAITLAALLLALATSRRSPGQEDVKTTGPAGAMNTLAWSKGQE

SEQ ID NO: 6168 - protein, 54 aa, Homo sapiens
  SITE (24): Xaa equals any amino acid
  SITE (25): Xaa equals any amino acid
MLCISVFCLLMTLLFPFVLVVLYXXLTFRSSWQYCFLHFIWDLSLFLIDHVCHC

SEQ ID NO: 6169 - protein, 30 aa, Homo sapiens
MRGLKPSWPQASLSPPPHALPCPCRVAMGF

SEQ ID NO: 6170 - protein, 44 aa, Homo sapiens
MNNTCLAVLHVVMCLAWSFLWSLLLHGFIHSFFSFISSCAVTCT

SEQ ID NO: 6171 - protein, 38 aa, Homo sapiens
MSSFSSALFCPLFFGSHFFLSIWVQMAFYMIENCKGKR

SEQ ID NO: 6172 - protein, 17 aa, Homo sapiens
MMAMLYTMLALDILVCG

SEQ ID NO: 6173 - protein, 34 aa, Homo sapiens
MLWFWGLWLQLWMWQLWVLLFGNYPHEVPRSCML

SEQ ID NO: 6174 - protein, 61 aa, Homo sapiens
MELVLAAAGALLFCGFIIYDTHSLMHKLSPEEYVLAAISLYLDIINLFLHLLRFLEAVNKK

SEQ ID NO: 6175 - protein, 61 aa, Homo sapiens
MPTTVPSSMFPCSLFLLWSQLWELLWSQLWGLLQLWGWWLLPEPPQAPSLPPAPAPEPRLL

SEQ ID NO: 6176 - protein, 40 aa, Homo sapiens
MTSMLLLVRWIPKLLLLLLSCMAPGYWGRSLLFLILKAGL

SEQ ID NO: 6177 - protein, 59 aa, Homo sapiens
PHLPLMIVNLILHFSCYCWCKKHLLYQDFKNQSDKSLISLIIITDKSIEFASDYFFFSS

SEQ ID NO: 6178 - protein, 11 aa, Homo sapiens
MGFEPGWPGKL

SEQ ID NO: 6179 - protein, 39 aa, Homo sapiens
MLLEKVIRLRCSCFVLLCFSLSWVGVSSSNDVQVDLFSH

SEQ ID NO: 6180 - protein, 71 aa, Homo sapiens [sequence omitted]

SEQ ID NO: 6181 - protein, 10 aa, Homo sapiens
MPGASRSVCL

SEQ ID NO: 6182 - protein, 39 aa, Homo sapiens
GVSKRFPVAATRTAWYCLHVLSYFCFALLQLLAVGPWRN

SEQ ID NO: 6183 - protein, 31 aa, Homo sapiens
MWPLRLLCTSWSFLRSPFLGLARLKKKTSSF

SEQ ID NO: 6184 - protein, 20 aa, Homo sapiens
MLHCYPALPSLIFLGVAWGF

SEQ ID NO: 6185 - protein, 74 aa, Homo sapiens
  SITE (33): Xaa equals any amino acid
  SITE (74): Xaa equals any amino acid
MFTYWFTMLFMCKLSKCKLNINVHALPKKKKKXSRGGPVPNSPYSESYYNSLAVVLQRRDWGNPGVTQLNRLAX

SEQ ID NO: 6186 - protein, 13 aa, Homo sapiens
GNKRIKRLMPYYF

SEQ ID NO: 6187 - protein, 10 aa, Homo sapiens
FGYFQIYVFS

SEQ ID NO: 6188 - protein, 44 aa, Homo sapiens
MFSCMSNLIYLLPVTYLIMWLLIGSHSPFLSRYSTTFQNSHWQV

SEQ ID NO: 6189 - protein, 33 aa, Homo sapiens
MRSWIDFVSIYSSALCIPWFLHPWIQPTKARKY

SEQ ID NO: 6190 - protein, 38 aa, Homo sapiens
MPCWVTGWTCCSLQSHSQPAHMPPSKRILLFTSLLLQP

SEQ ID NO: 6191 - protein, 271 aa, Homo sapiens
  SITE (211): Xaa equals any amino acid
  SITE (221): Xaa equals any amino acid
  SITE (233): Xaa equals any amino acid
  SITE (237): Xaa equals any amino acid
  SITE (270): Xaa equals any amino acid
GFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGPXPAAPLLRGAXCDCSGPISPSLXGVAXRQPWAPSWPGSYAFIMSLNKRHSSGDGNSKLKXE

SEQ ID NO: 6192 - protein, 38 aa, Homo sapiens
MLGIATVFFFGLGLEVVGKNACQPALHLGLGACQLPAL

SEQ ID NO: 6193 - protein, 18 aa, Homo sapiens
MGDLKLVLLISELIIEFP

SEQ ID NO: 6194 - protein, 31 aa, Homo sapiens
MPRSFLSTFLFFGTVRGFTLSSWTSLPQSWN

SEQ ID NO: 6195 - protein, 37 aa, Homo sapiens
LPFLSLCCAMSSSSPLVLGAWQEVAAIGCFLNEGANQ

SEQ ID NO: 6196 - protein, 68 aa, Homo sapiens [sequence omitted]

SEQ ID NO: 6197 - protein, 50 aa, Homo sapiens
MVGETCLLFHLGVTCSLAWRRREKTEKGVIPNICIAQSHTRDLISLAILC

SEQ ID NO: 6198 - protein, 22 aa, Homo sapiens
MVMVVVMMAVVLYFCAPSGPSH

SEQ ID NO: 6199 - protein, 124 aa, Homo sapiens [sequence omitted]

SEQ ID NO: 6200 - protein, 348 aa, Homo sapiens
  SITE (34): Xaa equals any amino acid
  SITE (37): Xaa equals any amino acid
MNMTQARVLVAAVVGLVAVLLYASIHKIEEGHLXVYXRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 6201 - protein, 132 aa, Homo sapiens
MLVIQITSVDFHGIPLSVPQSLTRRQCTCRGWKEDEPMSRLCINQGERKSRWKEVGRWRKQQLLLALDDGPEGLSLLVTPLWVLFPYLSVTRFLILIPCCEFGSLCWAIQSSSERAKLVLELRCRWGKRGLS

SEQ ID NO: 6202 - protein, 9 aa, Homo sapiens
MPLWAHLAS

SEQ ID NO: 6203 - protein, 59 aa, Homo sapiens; identical to SEQ ID NO: 3830

SEQ ID NO: 6204 - protein, 120 aa, Homo sapiens; identical to SEQ ID NO: 3915

SEQ ID NO: 6205 - protein, 101 aa, Homo sapiens
VQTLPLHPPGLPSSASSVSKMEPPHLRSTRLTRTHAPPSALIKPTDPDSLSATPGWSGPRCGSALSTPRAPRPSEGAPAGASDTLQFRAVGGLGHIPVPWL

SEQ ID NO: 6206 - protein, 32 aa, Homo sapiens
MLAAVGRPKPRSPLSSLSTLQLYLFCSSTRRS

SEQ ID NO: 6207 - protein, 282 aa, Homo sapiens
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 6208 - protein, 571 aa, Homo sapiens
  SITE (189): Xaa equals any amino acid
  SITE (531): Xaa equals any amino acid
  SITE (535): Xaa equals any amino acid
  SITE (538): Xaa equals any amino acid
  SITE (545): Xaa equals any amino acid
  SITE (554): Xaa equals any amino acid
  SITE (560): Xaa equals any amino acid
  SITE (561): Xaa equals any amino acid
  SITE (564): Xaa equals any amino acid
  SITE (566): Xaa equals any amino acid
  SITE (567): Xaa equals any amino acid
  SITE (569): Xaa equals any amino acid
  SITE (571): Xaa equals any amino acid
MSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQEXQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPXFAAXTAXLRQEPRXGMALLKVSXKQNRFXXAAXGXXTXSX

SEQ ID NO: 6209 - protein, 317 aa, Homo sapiens
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPHSFLSSPGSASERACWPCTIISPPVSPHVPALAKGLICRTTRTPASLLSPPWW

SEQ ID NO: 6210 - protein, 18 aa, Homo sapiens
MGQSVNHLRVSEYSQFSL

SEQ ID NO: 6211 - protein, 379 aa, Homo sapiens; identical to SEQ ID NO: 5134

SEQ ID NO: 6212 - protein, 9 aa, Homo sapiens
MVLSPLFSA

SEQ ID NO: 6213 - DNA, 131 bp, Homo sapiens
ggaggctgaggcaggagaatggcgtgaacccaggaggcggagcttgcagtgagctgagattgcgccactgcactccagcctgggcaacagagcgagactccgtctgaaaaaaaaaaaaacaaaaactggtg

SEQ ID NO: 6214 - DNA, 162 bp, Homo sapiens
agctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaagaacaaa

SEQ ID NO: 6215 - DNA, 100 bp, Homo sapiens
ctgaggcaggagaatggcgtgaacccgagaggcggagcttgcagtgagccgagatcgcgccactgcactccagcctgggcgacagagcgagactcccctt

SEQ ID NO: 6216 - DNA, 140 bp, Homo sapiens
ggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaagaggggaaaa

SEQ ID NO: 6217 - DNA, 114 bp, Homo sapiens
gaggcaggagaatggcgtgaaccctggaggcagagcttgcagtgagccgagatcgcgccactgcactccagcctgggcgacagagcaagattccgtctcaaaaaaaaaaaaacg

SEQ ID NO: 6218 - DNA, 61 bp, Homo sapiens
atgccactgcactccagcctgggcgacagagtgagactccatctcaaaaaaaaaaaaaaaa

SEQ ID NO: 6219 - DNA, 136 bp, Homo sapiens
ggcaggagaatggcgtgaacccgggaggcggagcttgcagtgagccgagattgtgccactgcactccagcctgggcgacagagtgagactccgtctcaaaaaaaaaaaaaaaaaaaaaaaaaaaaaaaaaaaaaaa

SEQ ID NO: 6220 - DNA, 123 bp, Homo sapiens
aggcaggagaatggcgtgaacccgggaggcggagcttgcagtgagccgagatcccgccactgcactccagcctgggcgacagagcgagctccgtctcaaaaaaaaaaaaaaaaaatgctgtta

SEQ ID NO: 6221 - DNA, 45 bp, Homo sapiens
ccagcctgggggacagagcgagactccgtctcaaaaaaaaaaaaa

SEQ ID NO: 6222 - DNA, 368 bp, Homo sapiens
ggcatgggcaaggacttcatgtctaaaacgccaaaagcaatggcaacaaaagacaaaattgacaaatgggatctaattaaactaaagagcttctgcacagcaaaagagtctaccatcagagtgaacaggcaacctatacaatgggagaaaaattttgcaatctactcatctgacaaagggctaatatccagaatctacagtgaactcaaacaaatttacaagaaaaaaacaaacaaccccatcaaaaagtgggcaaagtatatgaacagacacttctcaaaagaagacatttatgcagctaaaagacacatgaaaaaatgcccatcatcactggccatcagagaaatgcaaatcaaaaccacaatgag

SEQ ID NO: 6223 - DNA, 2925 bp, Homo sapiens
ctcccgagtagctgggactacaggcgcccgccaccacgcctggctaattttttgtatttttagtagagacggggtttcaccgcgttagccaggatggtcttgatctcctgacctcgtgatccgcccgtctcggcctcccaaagtcctgggattacaggcgtgagccaccgcgcccggctgagatgggtattattaagaaattaagatgtggattaccagggtaagtcatatttcaatgtgcaacctctgcaagtccacagggtgtgatatggacattaaggagatctatggacgaatagcgtatgataccttgacaagttgacaaaatgtaaaatagttgaatggccatagaaaaaaaccagctttttagccccataggccgagggattcaggagggctggctacgggcattttggaatggaagatgttgtaccaacaaatcaagcttaggttcctggcaatttgcccacatataatatgtgaaagttcagatgtgaaataaatctgcggctaatagtaagaacctagccacaggagttaaaacttacggttctgggaccagatggactgccttctaatcttagtcttactacattttagcggtaaaaccttcagcaagttatttagcctccagcatctcagttttctcatctgtaaaatggtgataatgctactcttacattgggttgtagtaggataaaaggagaaaacgtatgtaaaggatttagtagaaacttattaaaattaagcaattattatttctcaattctaagattctaacctgcaaaaggcataaggcagctgctgagaacagggtgagaagatagggattcggtcaggaaaagtcttgtttccctgttgctgttggtggttttgtttgctcatttgtgtgttttttttattaatcattttcacttgtgtttattgacaagcttaatcaataatgccattgacatttagtaaaagtaaatttccttaagtgatctcccaggtagcaatgtttattcattatgtgtggagtagagataggaattattttattgctgcaaatattttattattggtttttcaagttttaaaagtaattttaattttttaatttttgtgagtatatagtaagtgcacatatttatggggtacatgagatattttgatacaggcatatgatgtgtaataatcacatcagggtaaacagggtaagcatcacctcaagcatttgtccttttttgtattacaaagaatctaattatactcttttagttatttttaaatgtacaataaattattgttgactatagttttgccactgcaaacaatagaaggcttcctgatacagcctcctagtcattggagttctatggcagaattcctaaagtttttaagtttcatgagatggctaaattttggtaaatatgatactttctttgaacagatgctacagaggccaatataaaggagtgtaacagagtgacacctgtgatcagtatctctccaactacaaagagtgtcccttaaatttcttctgtgtggttcctctttttttttttttttttttttgagacgaagtctcgctctgtcgcccaggctggagtgcagtggcgcgaacttggctcgctgcaagctccgcctcccgggttcactccattctcctgcctcaccctctcaagtagctgggactacaggtgcctgccaccactcccggctaatttttttttgcatttttagtgagagatggggtttcactgtgttagccaggatggtctccatctcctgacctcatgatccagccgccttggcctcccaaagtgctcggattacaggcgtgagccaccgcgctcggcctgtgtggctcctcttaagtaatactctgcttcgtccatataagcagaggtcagaactggctaagaatttctttatgtgtgtttatcctgatgttttcctactgtcacttttcttttcttatggattagcattgagggaatggtcagatggtgcctgcgtgagtctgattgaaacattttagcggcggggtgcgggggttgatggcatgtgcaatagtttaggatatttgagttagtggcagaatgtagacatgagggtgagtagagagtgcgtagcagagcaagcaattcaggaatctatgttggttaattacttttgttttgtggacattttattctacctgaaaagattatctaggaactacagaaattaatgacgtgtagtggaaactttgcacagtgtaagtgttatccatttacttctcttagtttccaatacaatgactctcctggtagctgtcatacatgataaatataatttcgttaataaaattatattttatataattgcgtactttaaacaagtgatcaatataactcagttataaatgtacagtaacaaagatcaatggataataaatacttctgcgttcattttcatggatacattctatttttgtttgtctcacaagcagtaatcagactatgaatcatgatatagctccataaacacttactttatagcaattcactgatatatgctccaccaaaaaaaattaagagacggatacaagcaatttaaagcttctgtgtgtgtgtgcatgcaaccgatgtgtatggcttttttttttttttttttttttgacacagagtgtcgctctgtcgcccaggctggagtgcagtggcgtgatctccgctcactgcaagctccgcctgcctggttcacgccattctcctgccttagcctcccaagtagctgggacttcaggcgcctgacaccacgcctggctaattttttgtatttttagtagagacggggtttcaccgtgttatccaggatggtctccatctcctgacctcgtgatccacctgcctccgcctcccaaagtgctgggattacaggcttgagcctcctcgcccggcc

SEQ ID NO: 6224 - DNA, 102 bp, Homo sapiens
ttttttttttttttttttttgagacggagtctcgctctgtcgcccaggctggagtgcagtggcacgatctcggctcactgcaagctctgcctcccgggttca

SEQ ID NO: 6225 - DNA, 22001 bp, Homo sapiens
ggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggtaagctcggaagccggcagggcggcgctccggggcccagcgcgcaggcgccgcggttgggggccggaagcggaggcgttgcgcaggctcaatgtgccccgtgtgaaattcgggaccaggcgccgatcccactttcgaggacgttgccccgcaaaccttgtgcccacttccacgaaaccttccttgatctcgccctcgtcttagtttttcccccactgatgtatttcacatggctggaacagtgtctagcacaaaagagaagcttaacatttaatgaatccgtgaacccttggacagttcaaggaaattcggatcactttttagtttgcctgcacagcctatttattgagcatctactgtatgctaactacatgccgtgcacctgacttgcggaatccccaataagcactgttcgttcttagaggggcactgtcatctctgttgcacgaagtgagatggcttcagtgaggggaaggcacattttaaggagaggcggacagccaggctccacgccatcgggcgagccctttcgtgcaccgccccctagacacatacacacaaacacgggctttccgtatggctctttaaatctgtttggtgtacacccaactttcatttccttagctagtctgatcctccgccgtgggtgggaggtagtctaggtttttagaatctcagtaggctgctgagcgctgtttgaaatccgcgtcctgaaggcaggggacagggcttcagcagacttggggtagtcacttggagccatggctagaattcagatcgtctggcctaatgcatacctttatggctgttttaattgtctcacttgaggttaggaacccctttggtttaggccagggacctcctcccatacatccttgatgacccgtggtttactatttgaaagggagtttacaaaacccaggcgttgcctcatctgcctaccctcacccccagctaggacaggtgcctcttttaggcgcctagtgctccctttctcataaccccagcaccctggactgccattttctgtggtgggcaccagactcacagttcttgaattacctctaggttctgaatgtcctgcctataactttctccccaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagtaagctggcctcacccacttcatcagaggggccatgaatcgagttggagggagggggcactttagccattggttgtgaccaaggtcaaacaagagtgaacacacagaatttaggaccataccaaggcatgacactcaaaaagcgttggctattgccgtctgggcgcccacaggggttggaggtagatgctagaggtccccagctgctgggcaaaccgctcagttctccaaactggaggagtctcaaacctgatgggcttttaaaaatttaaatcagccggctgtggctcacgcctgtaatcccaccaccttgggaggctgaggcgggtggatcacctgaggtcaggagttcaagaccagcctggtcaacatggtatctctaaaaatacaaaaaaaattagccgggcatggtggtgcgcgcctgtaatcccagggaagctgaagcaggagaatcgcttgacccaggaggtggaagctgcagtaagccgagattgcgccactgcactccagcctgggtgacagagcgagaccccatctcaaaacaatcaaacaaaaagtgaatcaatcgcctcttgctttttggctaagatcaagtgtaaaaggtacatcagtggctgtgcatggtggctcacgcctgtaatcccagcactttgggaggccaacgtgggtggatcacctgaggtcagaagttcaagaccagcctggccaaacatggcaaaaccccgtctctactaaaaatacaaaaattagctgggcatggtggtgtgtgcctgtaatcccagctactcggggggctgaggtaggaggattgcttgaacctgggaagcagaggttgcagtgagccgagatcgtgccactgcactcgagtctgggcaacagagcgagactccatctcaaaaaaaagaggtacatcagctcttgtcatttatctgctgtctctggacttgctgaccccacccatcgctcctctgctttgcttgatcccttcaggcttctcttcaagtctctctgcaaagatgcctgcctctgaacactcaagtggctccacttgtcccctccttcccctgctgttactgtacctgctactgtccccccagggggagctttgcctctgtttgtcttccatccccagcacctggtccaactggttcataacaagccttagatacctgttcgcttagatacctgtgtcagggagacacacctgacaccttgaaagattatatcacatctcttgtatttcctggccccctcaggagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagtaagaagaccccacctcggcagaccagggcccagaccttcagggcttggcagcagcccagcatgggcactgcagcgtctctggtcaggacagccagggactccgtgaagggctggctaggtggagaagtggttctcagcatgtggtccagggagccctaggggtcctgacaccctttcccggggtgctgtggtgtcaagcctattttcctgacactggtggacttttccactcgtgttctcaggcatgtagtgcaggtttccagaggctgtgtgatggggagacaccctcactctgatggccaatggcagatgcttgtgtccaaactttcttagttttcactaatgatttgcagcatattaagagaacccatttaaacaaaagctcttggggtccttggtttttaagagtataaaggggtcctgagaccaaagagtttgagagctgctgggttagagagtaaaagcaggcttctgtctccaggatgctgcacccctggtctagagggggtacactgcctgtagtcttctttcctctagaaagggaaactgagggccagggggctgctaagtgtgctttcttgacctggagaagcatcagattttaaagactggggaggaccaaagcccacagaagggaaggccagagacgtgcccatggcgtcccagcaccaagtggctgcttccagcaggcctaaggagctgaggctggggtgtgctggatgcagcggggcttccaggcggcagctccctctatgggagaggttgggggaatggcctcctaggggctaccagctttctgacctcactcctctccccacaggcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgggcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcctcacaaggttcttcttgggtaggaaatgttatcatgccacttcagcgaggaggaaacggagggggccgcagaggttccaccgaagccagctgccagaacggggccccagccccaggtgtgagtgcacagccttcgtttcctcgagggctgtggcttttgagcacctctcacgtgagtacaggatgcacagcctagcatttaatcttcacaaagacctcgaggcagtgggtactgtcacccttgttctagagaatggaacagtctcagagtctaaatccaagcactctgcagggacattttattggtgacggaagtggtgtgggaatttctgaatgactggatgccctgaaatgtactaacttggaggatggttttgggccaaaccaggaaaggacaggaagtctgtggttaacatctgaggacacaatgggagaggacctaggttctaaatgaatgtcttaagtgcttcaaagatggcaacctgggagaaccaggagaggggactgagttctctgaggacaaggaccttgtactacttcatccccatgaaggggctcggcatcagggaagtatttggtggaaaaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggcccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagagaagctttgagaaggaagaaaaactaatgtgtgatgagagctgagagaggaggcaatttagaaaatttcccaagtggggatgagggtggaggtcactcatgactcactggggttgggagggggctggacagctccccagtggtctccagggaggcctgagaatgtgccgatgagcagagtggggtcggcctagactggggctgctggagcagggctggggaggggccgcgggtgagccagtgggcaactggaagcggggctgaggtgtgcctcagtggaccagcctcgctgtcaacccaagcagttctaacatctctgggctggaaggcggggacggggacaggtggatttggggcaggggcccaggagtgggaatagggagggggtgcggtcccagtggccgcagtggggcacccacctcacccctccagcccgaggggggacggcggcggtggcggcgaagccggggggcccgaggctgccccgggggccctgctgtacctccagatagtagaagatgaagaagagtgtctcggtcgacaggcgctggtagaattccacagtgtccgagtgtgggggtggcatctggtggtggtaggggggcgtcggacaggggttccgggggaggtactgcctgtgagagcaacaggaaggtcagtgccagctgcctactagtcctgtcgtgatcaaaagggtgctcagacatgcatccctgcggggggaggtggtacagaaagacccagggcggtgctgaccttcagtggagagcccaagtcaggggcctggtgctctacccacagcctcacaggttcagccactgcctcctccgtaagactcaagtcccagaccatcccccttccctgtggcccctcaccgaatacgctcagagtcagaggggtgaggcatgtggtgccaggcggcctcttccatggcctgctgatagagctgctccttggtgaggggcacagggcccagtggacagacacccagcgacagcggtatgttcacctctgacagctgcaggggcggctgggctgaggccggaggtgctgatgtactgctcaggatgatgtctgtggggagggtgggggtccggccccctcagtggtgaggatgggtcaggggcagcccctcctctttggcccgctgcttccccaccatcctgggtccctcacctcgctcggtcaggtgcagcgttggcacagggtcctcaatgccagagctgatggctgcccgttccgccatggacttcaaggagctcagaggctcaggggcctggggaggaaacaagaggcctggcctgagcacttgggctgcaggagcaagtgcagcctgacacaggccccagatgctctcacctgccctgtttgggggccgtggagggccaacgacccactccccacaatctacccatgacaggtaaaagcatcaaactgtagggaaacaatcggagaccacgacgcattcatcagcagaggaacgtctcgtgagtgggactctgcagcatggaatactacgccgagattttcaaaatacaagttcgtgacatactacagaagtaaacgccaacctgcagaatatgtacagtgcgctaccatttttgtcaaaggatgtgccaatagtacacgctccttcactagggacacctacacgctgggagagctcccgcctgtcttgaaggaggcaggaggtctacatgctcagctgtctgcctgtgactggcatggggtgactggaatcggggtgggcccagcccggctaggcttcagtctccttgctggaaacaggtaggttgggtctccagccccgcagccacagcctcgtttcctattacaaaggttacagcaggcttctgttccccaaagtcagggctggttcctcccatctcctccagccacgtgcagctgtcccaaaccccagccctgtgctggactctccacaacgagtcagtcgccaaggcttatccattctgtctcgctatatcgcccaggcaggtctcaaactcctgggctcaagctatcctcccgcctctgcctccctaagagctgggattacaggtgtgagccaccacgcccagctatccgtcctgcttctaaaccccactggatggctcccttccctgtcgtgccaccatgtcccacacagcccaggcctgtcctctcctgcccagaccaccctccctctatcctgtcctcaccagccccaggggacctttccaatgaagtcatgttgttccttctctactccaaaccttgccatggttcccgaccacccaccccagcgattcatttttgttgttggtggtgttaaaagatatggaccccttctgaaaatctcaaagctgctgtttccctttttccagaaaaatgcacgcactataaatatcctgtccacctacttctaaaatttgggccgggcacggtggctcacacctgtaatcccagcactttgggaggtcgaggtgggtggatcacctgaggttcggagttcaagacctgcctgaccaacatggcaaaaccccatctctattaaaaatataaaaattagcctggcgtggtggcaggcgcctgtaatcccagctactcagtaggctgcggcaggagaatcgcttgaacccaggaggcggatgttgcattcagctgagattgcaccactgcactccagcctgggtgacagagcaagactctgtctcaaaaaagaaaaaaaaaaaaaattaatgcttctgttgggccagaaactgttccaagagctttatgaggatgatttagtcttccaaataaccctacatagtaggtataatcgtgactattgccgtttcccagatgaaggcacagaaaggacaatgccaagacttggacctggacagcctgggcgcgcacactgcctcctggacagcctgggcgcgcacactgcctcctggacagcctgggcatacacactggtccccccatggaagctgcgctacagtatactggctcacaagccaagccccagctcctgaccctcgatgatcaggaccccaccgtcctatcctgctacacccactatctcagccctgcagctggtggcactgtctcctgcagagtggacacctctctcctctctgctgcatcctgcccagcttcctaagcacacaggcagatgcatgctcctcctaaagcacctcctgaagcccttcctgcagctgttagcccccctgcctggtccaggtctcagcttaaacatcaccccctctcagaccttcctgggcctgtctcccaggtcaggtcagatgcccctcggtgggcccaccgcaaccttccctgcagctgccccagcagggaagcttcctaaagggtggaaccaggctgcattcacccaaccagtctttctacttgtgcagaaagtacaccagtctatgccttgtgaggacaaacggggacagaaactgagggcctgcgggggggatgaagatggagacccagagagagcaagcaacaagtgcaaccaagagaaaggaaaagagacccagagaaacagagctttggagggaacaagagaggaggtatgagagcccccagagatcaaggtcacggggagggtggtacagaaagacctggagaaagagcaagtgtgagaaggggacagaaagccagagaaagagatccagaaagagggtgggggcagggggtgcagctagagacctggaggaaagaaacaacagagtcaggacacagaggctcgggggatgtccgaggagcccaccttgatttctggggcggtgctgaactgtggaggcccattgagcagggcaccggctgccttggcatcactgaagctgggcgttggggagctgggaggattcacaggcagtggcaccaggaggctgggtccccctgagttgttccctgagcctggggccacgcccccagcccccgttggggctgccgcactgggttccttcctggagagagagcatggaagagggggttgagaggagggtccctgagggtgggatgggcagagaggcctggctggagagaggggagactgcacagatcagatgggatctgagaggggcaggtgagggcagacagatgggagaaagaagtggttctctgggcaaacaaaggcagagcccaatctttggaatggtttctcatcagcagagcagagctgtgggggtgggggtgaggattctcgggtgctccaccaggccacaggctgatcaaaaccacttgccctgggcaggtgttcacagggcccactcccccttgggcaggccagctggagctggggtgagggggcaggaagcaggcctttcctttgtgcacactgatctttcttagggcattcttcgggaaacaggcagacccagtggaatggtctgagctaagatttgaaggagtggctgcagaggaataaggacttcgggacaattcactttgaaaagtgaaacagtgaccctccggtggcagtcaattggcctcaggcaggtaacagaaatggggaggaaagggtatggggctcttgagaaaacttccacttagatgagaacgtattttagaatgttctgaagggcaaagcagggaggctgatgtagtttccttgctggaaagaagtgggggtgtaacacccgagggagatggaggatagcgcttggccattcccagcagcaagggcggggggttcagaacccaccgatgcgggggtgaggcgcctgcgcctctctgtttcaaaaggctgccatcccaaccctgccgatggccgagacactcacgaggtgctgggaggtgggttgtgggggccggaaggggggcccaaggcctggctgctggcattgttgcccccactgctgctcaaagccacctctgccgggctgtctgccacaactgagctgtaacctgggaacaaagagtaaatggaaagggctgctgcctgctgcccagccccgcccacgccccccaccccgctgcctcctcactcactggtggcgccattctgcttgccagcccctccaccggcactgctgttactactgctgctgctccctccacctccgctgccgccgcctccgcctccgctaggctggacgctggggggccggggctgggtcgtgctgggcccactgggagctggtggggccacagcctgggcatagggagcaggggtgcccgagttgtggctgggagctggactggccttggggcccagggcacttgggggtgctgcgggggcggggaccccattgttgccaggagtggtgctcaaggcagaggcagcaggcggggggccggaggggtaggtgggcggcacagctggggactgagggtgctggttgctgtggacaggcttggagccgtttttggctggagactgcgggtgggagagagcagagggtcaggacccagtgggccagctggtctccctcaccacccccacctcaggctccatctttgtcccagcagcctcctctctggcctcgctgcccccacctgctcctgccctcttggggacctgggtgaccttactcaccctcatggcttcaatcaccttcatgcttaaaacactcacactgatttccagcctgcccagcttcccaagtcctgcctggacaccgccccatggacacccccacagggatctgacacacaacttaggttgtcagccagagaagatccatctgttggaagccagaggactagtgggaaacacttaagtgttctcaatatgagattagctggagccgcctaatgtccaagagtagaaggaaaaacagctggaaattggatagtaattctgaatgtcacctgaagggtcacagaagctactcacagggctggaagttaccagcactccagaaagtggtgggagggtaaatgtgctcatggtatccctaccgcaggcaatctgtggacagcactccggctgctgagcctaaccacctcctgggcttctttccagccaccccacaggcaccttgcgcttaccaagcgcccaacaggactgactacccacttctctcctgggcatcgctgcttggcagtgggggcctgggaaggtggcagagcccagcctggcccctggagtacctgcctcagtgtctctcctcatcacctcctggccctgttgcccgccctcactactacctgcgggtccccttagtctccacaccagcctcctcaatgcccactcagggtgtccccttggaaccatccatcccgttagcccacagaggggcctcaggcccatgctgctcctgcctaacattgttctgtagcagcgtttccgaaagcgtgctcctgtcctgggagatgttaaaggagttgaagaagcactgcccgccaccgtctcctctcagaaatttgcagtgtgtattatcagcacagcaaaggccccatcgcttcctaggcttattggactctggaggccactcaggtccacaaagcctgagcccctcagcctgacagtcccagtccctgtgctcacagttgggcccctggccctgcagacctggccagactcatctctcctcacttccaaactttctgtcacaacttgcccatgttactggctgccacctctccctgccaggcaaactcacctgactgtgaagcccagggcactccacagcagcatctcctgactgcctggccaggccaagggtgacctgtgtgctacccccttgaccacagcaccagtcacctgtccacttgccctgcccacctgccctcagggcagcactgatttctgagccacctgtgtccaccagcccagcacagtggccggcgctcaggcctcaagatgcctttgggaagcaacagaggagtgaatggcgtgcccacccggtccaggctcacacccacctggctgacttcactgtctgtggaacgtcccctcttcttatcatcttcagagttttcctgaggtaggggaggcagaatagaaacctgtgtgacctctggggctctgatggagaaccgccaatctctgaatgccccggggacctgggcccaattgactgccattgcggccccagagctggtcaaatggctgtccttaatctgcctggagaaaccatctcaattcaggctctccagtcttcttgttttctgggagccagcactgacccaccagcctcttaaggatctgggaacctgctctccacagggaagccaacccttggatccctgcccaaggtggccagctacccagcctcctcaggcagcccaggcaccggcccctcccacttcccagatccaggacctaaactggcgcgggatgcaccctattgctctttatgtcctttagggacccagatataggaccttagcgtgtgctccaagagcctagaccctggatacctagatctgtgtttcctcaattacgctcccatagccactttggagtgacccagatttgtctcctcgagtcctgccctgctggaaacacaaggtactagtgtcccgtggggcctcaccgtggtacagttggctgggctgggcgggatgggagagctggaggtggttgaggtgggcgtgctgctggactggttgaagatctcatcctccatgtggctgtggctgggaggggaggtggcgaccagcgcctgtgctgtgggggcagaagaagggcatgcttagctggctcacacagcccattctgggccctcacttcctgtgccacgatcagccccagggcctcacgaatgtcctcgaggtccaggtcatcgtagagaaactcgttctcctcgaagtcggggtcctgggatgagtcaacatagtactcaacgtcgtccttgatcttgcggatggcgtcaacgaggatggagtcattgtccagcatgcgcaggatggtctctagcatgcgcacgtggtagcggtgcttctcgatgtgccgcttcaagccctcaatccggtcctgcttctgctggcgagcccagggccaggctcaggggctgcagagcacctgcttggcccctcctgcccccacagaacctgtcctcagtccctgacccctgtggagacccaaagcctccacgccatccccttcggggtggggcagtatggggtccacccaccctctgagccctgtggggaccaatcttagccttgacatcttgggatcccactgctccctcctctccccacacctttctggctccaggagtccttggaaacctctaaaagacccagaggtccttgtgccatcccacgacttggcctccatctgcacctcacctgacagcccagatttctcaactgagcccgcccaccactgtgactgcctctggcatacagataccctccgacctgctccagcagtaacaatgataacccccatttgtgaggagcttgctgtttagaattgtgatatctgtcatcactaggcccccaaccctacccatttatccctgagagagcccagattcctaagcctcgctcctgccctcccctcaaggcccctttaggatttaacatcttagccttggttccaaatctctgctctgttcaaggacccatcatctccccgaaagcccctggttcccaaacccctcagagtctgacacccaaccctgtcatcttccacttcctgaccctctcccacccacagcttccctgaggacccggctctcccctccctgtctttctggtttcagcaagtctgtacagtttgtatccctttgaactcataccccacaatcccggattttagaacctgggaccccaacatccagctttgtcccagactcctgtcttccttcaggcctggttctctgccttctccatgttctgccttgtctctacccactgtgctctccctaggaccagggccctctgggtgccaggaggcctcttgccatgggtgtccttcaggtctcacttttactctgtggcccaagctcaacctgcactcaccttcccccaagtcgctcctcttcacaaaggccccacggtctacccagacacccaggggagcctgagattctgtctgacctccttcctgccccacgcgtgcagctgctaagccctcccaatcctgtctctcaaatccctaatcccggctgttggccctgtccgcctgaggaatccaggccccaactcccaggagcataaatgactggcctcctgctggccagcccattcccatgcccatccccatcccaaaggtgtcgggtctccctcactcacatccttgtcgcccttcttcttgcgtgtctgcactgacagtgactccacttcactctcaaactggtccacctgcatgttgagcgtgtcgatggtattctaggggagggagaggaagaggaagcccatcagctagggttccgcctacacccagggctcaggatcctcagagttcacctcctcttctctaccccaactcaccgtgagccactggccaacctcttccttctccttctgggcaggatctaccttctgggccaggcccaggccctctttgctgtaagctttggttttggtctctcgttccacaactttgaaccgttccatttgctgtagagagtgcagttggcaggggggctctcaaaggtgggaaaggagctgactaagggccagcagacactccgacctgagcctcgtgaccctactttctgagctctgagtccgctgcctcttcacttcccttaggtgcagaaaccttacttctcttgaggacctctggggtctggccgctctgcctccgccccttgggatctcaagaatctggtgaccttcccacctctctgggactcaggctctgggctcctaccgtctcaatgagcttgcggttgtctataagctgcctcttgtccttgatctcgttggacgctacccatgtcttgatttggtccctcagccgctgcagatgggaaaagcaagaaagtcagacctcaggacccaggaactggggcccacagctccttctccctgggacccagcagtccactctcccagttccctctaccctcaggacaaaggcgtccaggcccccagccccctcacttgtagcttcttaatctccttctttaggtcagcctcatacttttctttctggttcgcgttggctgcattgtggagctgagggatggagagaattgagaagtcagtgtgggaggggatgtcccagtacccactccagtgattcttccttatgctagggactcgaggaccccccccaacccctacccccaatccatcttagagctgattctcttaggtcctcagcatctgcatatgtagcccctcccgctggtcaacacccagaggtcctgagccgccttcctgtgccctcctctctgaagacccagattattagggtctcagcccctgtaccttctgccaaatatcttcaaactgctccacgccctcggacaccttcttgaggcagcgatcaatctcacctggccagggaggaacaaggctgtgagaatcctgcccaggtggcaggtatctaaagagcagtcctcagaagagggagcatgtggctacaggtgcagcaggaagtcagtctagtaccttggagtttgcgcttgtccgccatcttccctgccctacagacgcactctcttcatactctcttggagacggacgctgctaggagagattggagaggaattaacacgtattccctggctggtaaaaacccagagacatggacctagtcagcatagtgaggtaggtgggactggtaaagagaagaagcatttgctatctgacaagagaccagccccagttctcctgatgctcgcttgactgcccagcatagtgtctggccaacaggggaccccataagtttgttgaaacaagaaaagttacatacttttttgtgtgcctctgactcaggaagtggaaaattcctagagcatggagtaccttctccccagaatacactcaaaaaggtttttcagagcaggacagtcatgctgcacacagctgatgactgggatggaggcattagccctggaaatcacacttcctactcagaggggctgggcagaggtggctaggagaggtcatccctcagacaagtcaggagacaaatgaaactggcagctcacagagaagggcgtgtgtgtgtgtgtgtgtgtgtgtgtgtgtgtgtgtgtaagctgtaggtaggagaagaaagattgggggtgggggaaaacgacggcgagcagagatgccgaaagctgtgaagagctgaacccgctcatgcagacagggctgaatgccaagtagaagggactcaaaccaccaagacatttattccagagcaggatccttaaaccaaaaggaaataacactcctaacccaaagaagctaataccaagaaggcttagagatttgggggcagaaggcagtacccaagagagacctgggagaagacagaaatcttactaagataagagggtgcaaaggtaccgcagctgtgagggagccgatctgcactcatggaggaatcccatagcaagtggattggtaatttagagtcagggagacatagaccatcagggcaggaacccaaaacttcaagagaggagcgtctttattttaaaggaagttacctggaacccagagaagactgaggtcaaaagggagttccaaggagctttagtccaagggaagacataccttagggcctgacagcgagaccaggggagccctgggaagagaggcttatgcctcagaagaagacttctgagataccagcggagattgccctcttcccctccagggagggggcctacaatgaaaagcacagttccctgggatccacgggccgctcccactctacgtgtgcagggcagggaaccctggagtagtcacttactgtaaagacagaaacagccccatactgaggaacaagagcctcaatacagagggaagtcacaccaaaagagtcctcacccacaaagaagggaacatctggcaaacagtgctatccaacagaactttgcaatgctggaaacactctatttgcgcatatctgttggccactgaacatctgaaatgtggcaagtgtaatggaggaactgaatttttcatttttaactagttactaatcaccacatgtgactagcagcaaccatatgggacggatatgctttagaacaagaagcccataaaggacagggctggtaccttacccccagggagaattttcccaacaccgcagggacccattctgggtgataataggtaggggtgctaccttacacttgagggaatttaaatctcctcagtaaaaggcccaacctaaagaaagccgcagcagcccccgcccaggtcagctatcacgccctacctggggaatctctaagaaggcaaagcaaccaacaaaaggacccaggagaaggtgccacagtggggattcaggctgaggaggggaaagcccctttgacccagggagctcacacaaggcaagggcctggacaccagagctcaggtgtgcagggatcctcaccaaagtccaacaccccaacacagaaaagcctcttactgcatagggggaacaagaatgtgaaacgagagtttacactccctctttccatcccaagaacccaacagagggtcatgggcaggtgctccagcccagagagagaagaggtctcatggtctacacccctaaacaaggcaatcaacaccttaggcaggtgacgccctccctgtgtctccacacggaaaggactggtatcctagtgcagaggaagaatacccacagagaggagaccacactgtggcagcaagagaaggaagtcctggaggggtcacaagccagaaggaggggaacaagagcgctaacccagggaggtgatgtttcagacagaacagtgtgacatcgaagtcggctacagctgagacccagtgaggaggcagctcctccacagagaaggggcaagtgccagaggcccagggtacttgtcccctagagaggctggagccttagccacagtagagacaacaccttccccgctaagaaaatccttatatcatgagggtatctgtacctctggtccccccagcaaaggaccagagagaagggaagctggagcctgagtctcgaagcagagacgccgccagagaagaaagagccccatttgctgtagtcaggggggcatccaccaagatcctccaaggaaggtggtgatcgcaggtccactctcaggcgtgaagaacctgtgctccagcagcaaaggctctccaagagcactgaggaatctgggaacctcggcccaggaggagacttacccaagaggaacacacatccccacagggaagggacccacaaggcgggtggcggggcggggggaggtgagcaggacaccagcctcacaggagccaacacgctaaaatcagagccaaaaccagtaaagaagagccccccagacttcatctcagggaagatgataccaccacacaaagactcgaggagggaggggcaggaggtcagccctgggaaactaacaccgggtggtccttaaccttgggggccgtcatgtgcccacagagtggtctttgtcatgaggcacctttgatctgggagagcttccgcctctgcagcaaggagctctgagaagtgatgttgaagggtgatccttaacccaggtggctgctgacgtggccacacagaggctctgagactccagaagaaggatgcgttagggcctggggtagaggtagtcatctccactgagatgccccatgccaagggtggggggctggaatctcccaccttggaaagtctacaccagagaagtctctggtcccagggacagggtctacagtggagtctcccgcttgagactcaggtatcttacatccacacagccaggaaactatgccttaccccatacagtgacaaatcaagagggggttttggaagcatgagccgggggcacctgcatccgagaggggtcctcagccttacggtggggacacatgcagaggcgtggacacctcaaatccagaaaagcagccataccaataccaaggatggcaagaaccttatccctgggggaggtgacaccaagaaagggtccttaccctggagagaaggcacagccccagagggaagagcccccacctcgcagtacaggaacccgggtctaggaagcttcctactctcatggggtaccagcagcggggccagaaggcgaaacccttgttctccaactgctgacacccagcgtaagggtagatgggaagtcaacaaacccacagtgtgggatctgatgcaaatatcaagggcagtgggcttcttggtccttggagagctgacaccctaaaggaggagactggtgtgaagatggaagaagcctcatactcaggcaggggtgaagggagggaggggagacatcaaaacccctcaccaaaaggacaggagagctcaccccggggtgggtggccgccctgcactgagaggcagggactgctcagaaagaggggctggtgctgcccgcagtgggagctcactaacatggacagcgtggcggcttagtgtctttcaccaggcacctgagcgccaggggatcccagcagcccccagcaacaagaccacagtggtcctgatatcactgggagacgcccacacccagaaggtcggagagtcacgatgcaggggagttcaaggctgcaaagccaggggcagacgccaggatcaaagaagtgtgagagctgagaccagacgtgggccacactgaggacggtcctgtaccccaggtgggggaaagccaaactcccccaaaaaggcaggcgcccagtgcagcgggatggcgaggctggagccacccagggcgctactcgctatgagagggaagagctgcagactacagaggtggaaacttcggcaaaggctccaactaacggggagtttctcctccactcctctcccaagaggctcccatccgatacagacgggcagctggaactgagatccaggggcgaggctgccgcgtcccgggacgccagtgaggagggatgcggaggcgcctcggtcctgggaagggtgactcccccacccagctggggtcctcgtcccgaccaccaccccccctccccgccaccgtcgagggagaagccccggcgcggagctgccccacaacgcgaaggaccgaggccgaggggggcaggcacctgagccccgagagggcgggcacctgggaccaggggcgcctccatccttccagccaggagccataccgacgcggagaggggcgggcacctcgcgcccgggaggcttcgcaccctcacacccctaccggggggcccgacgcgatgccacgcggggaggcggcggcgggcggggcccggggctccgggctcgcggaaggacccccgggaggcgctgaggaacgtgaaagaggcgcaggaacgggagggcgagagggagggagccgccccccgccgggagccccgcgctgcagaggcggcggcagggggcaggcgaggggaggccatgtcgcgacagacggcggtgtcgccagggcgggaggcggcggggagggcggacgatggcgccggggggaggaagggaaggggtccggcccagtcgagcctgacgctctcaccacaggagctggcgccgccgctgaggagcgtatcgcgacaggcgggggaggcgagcgcccgccgcctttttctcgcgccccgggcccgggcgctatcgcgatagcggcgcgtatgtcggatagtgggtttgtttgattgggcccggggttgttctgacgacgggggtcggggctcaagggaggccgcggcgtctgccgatggctccgcggaagctgaccgggccc

SEQ ID NO: 6226 - DNA, 13994 bp, Homo sapiens
  misc_feature (156)..(156): n equals a,t,g, or c
  misc_feature (10132)..(10132): n equals a,t,g, or c
  misc_feature (11830)..(11830): n equals a,t,g, or c
ggaagtgcaaagaggcgggcgtgccagtccctggacagctacgacgccatgaatatcttgcccaagaagagctggcacgtccggaacaaggacaatgtcgcccgcgtgcgacgtgacgaggcccaggcccgggaggaggagaaggagcgtgagatngggtgctgctggctcagcaagaggtaagctcggaagccggcaggcggcgctccggggcccagcgcgcaggcggcggttgggggccggaagcggaggctttgcgcaggctcaatgtgccccgtgtgaaattcgggaccaggcgccgatcccactttcgaggacgttgccccgcaaaccttgtgcccacttccacgaaaccttccttgatctcgccctcgtcttagtttttcccacactgatgtatttcacatggctggaacagtgtctagcacaagagagaagcttaacatttaatgaatccgtgaccccttagacagttcaaggaaattcggatcactttttagtttgcctgcacagcctatttattgagcatctactgtatgctaactacatgccgtgcacctgacttgcggaatccccaataagcactgttcgttcttagaggggcactgtcatctctgttgcacgaagtgagatggcttcagtgaggggaaggcacattttaaggagaggcggacagccagctccacgccatcggggagccctttcgtgcaccgccccctagacacatacacacaaacacgggctttccgtatggctctttaaatctgtttggtgtacacccaactttcatttccttagctagtctgatcctccgccgtgggtgggaggtagtctaggtttttagaatctcagtaggctgctgagcgctgtttgaaatccgcgtcctgaaggcaggggacagggcttcagcagacttggggtagtcacttggagccatggctagaattcagatcgtctggcctaatgcatacctttatggctgttttaattgtctcacttgaggttaggaacccctttggtttaggccagggacctcctcccatacatccttgatgacccgtggtttactatttgaaagggagtttacaaaacccaggcgttgcctcatctgcctaccctcacccccagctaggacaggtgcctcttttaggcgcctagtgctccctttctcataaccccagcaccctggactgccattttctgtggtgggcaccagactcacagttcttgaattacctctaggttctgaatgtcctgcctataactttctccccaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagtaagctggcctcacccacttcatcagaggggccatgaatcgagttggagggagggggcactttagccattggttgtgaccaaggtcaaacaagagtgaacacacagaatttaggaccataccaaggcatgacactcaaaaagcgttggctattgccgtctgggcgcccacaggggttggaggtagatgctagaggtccccagctgctgggcaaaccgctcagttctccaaactggaggagtctcaaacctgatgggcttttaaaaatttaaatcagccggctgtggctcacgcctgtaatcccaccaccttgggaggctgaggcgggtggatcacctgaggtcaggagttcaagaccagcctggtcaacatggtatctctaaaaatacaaaaaaaattagccgggcatggtggtgcgcgcctgtaatcccagggaggctgaagcaggagaatcgcttgacccaggaggtggaagctgcagtaagccgagattgcgccactgcactccagcctgggtgacagagcgagaccccatctcaaaacaatcaaacaaaaagtgaatcaatcgcctcttgctttttggctaagatcaagtgtaaaaggtacatcagtggctgtgcatggtggctcacgcctgtaatcccagcactttgggaggccaacgtgggtggatcacctgaggtcagaagttcaagaccagcctggccaaacatggcaaaaccccgtctctactaaaaatacaaaaattagctgggcatggtggtgtgtgcctgtaatcccagctactcggggggctgaggtaggaggattgcttgaacctgggaagcagaggttgcagtgagccgagatcgtgccactgcactcgagtctgggcaacagagcgagactccatctcaaaaaaaagaggtacatcagctcttgtcatttatctgctgtctctggacttgctgaccccacccatcgctcctctgctttgcttgatcccttcaggcttctcttcaagtctctctgcaaagatgcctgcctctgaacactcaagtggctccacttgtcccctccttcccctgctgttactgtacctgctactgtcccccagggggagctttgcctctgtttgtcttccatccccagcacctggtccaactggttcataacaagccttagatacctgttcgcttagatacctgtgtcagggagacacacctgacaccttgaaagattatatcacatctcttgtatttcctggccccctcaggagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagtaagaagaccccacctcggcagaccagggcccagaccttcagggcttggcagcagccagcatgggcactgcagcgtctctggtcaggacagccagggactccgtgaagggctggctaggtggagaagtggttctcagcatgtggtccagggagccctaggggtcctgacaccctttcccggggtgctgtggtgtcaagcctattttcctgacactggtggacttttccactcgtgttctcaggcatgtagtgcaggtttccagaggctgtgtgatggggagacaccctcactctgatggccaatggcagatgcttgtgtccaaactttcttagttttcactaatgatttgcagcatattaagagaacccatttaaacaaaagctcttggggtccttggtttttaagagtataaaggggtcctgagaccaaagagtttgagagctgctgggttagagagtaaaagcaggcttctgtctccaggatgctgcacccctggtctagagggggtacactgcctgtagtcttctttcctctagaaagggaaactgagggccagggggctgctaagtgtgctttcttgacctggagaagcatcagattttaaagactggggaggaccaaagcccacagaagggaaggccagagacgtgcccatggcgtcccagcaccaagtggctgcttccagcaggcctaaggagctgaggctggggtgtgctggatgcagcggggcttccaggcggcagctccctctatgggagaggttgggggaatggcctcctaggggctaccagctttctgacctcactcctctccccacaggcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgagcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcctcacaaggttcttcttgggtaggaaatgttatcatgccacttcagcgaggaggaaacggagggggccgcagaggttccaccgaagccagctgccagaatcgtccccagccccaggtgtgagtgcacagccttcgtttcctcgagggctgtggcttttgagcacctctcacgtgagtacaggatgcacagcctagcatttaatcttcacaaagacctcgaggcagtgggtactgtcacccttgttctagagaatggaacagtctcagagtctaaatccaagcactctgcagggacattttattggtgacgaagtggtgtgggaatttctgaatgactggatgccctgaaatgtactaacttggaggatggttttgggccaaaccaggaaaggacaggaagtctgtggttaacatctgaggacacaatgggagaggacctaggttctaaatgaatgtcttaagtgcttcaaagatggcaacctgggagaaccaggagaggggactgagttctctgaggacaaggaccttgtactacttcatccccatgaaggggctcggcatcagggaagtatttggtggaaaaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagagaagctttgagaaggaagaaaaactaatgtgtgatgagagctgagagaggaggcatttagaaaattcccaagtgggaatgagggtggaggtcactcatgactcactgggggttgggagggggctggacaggctccccagtggtctccagggaggcctgagaatgtgccaatgagcagagtggggtcggcctagactggggctgctggagcagggctggggaggagccgcgggtgagccagtgggcaactggaagcggggctgaggtgtgcctcagtagaccagcctcgctgtcaacccaagcagttctaacatctctgggctggaaggcggggacggggacaggtggatttgggacagggcccagggagtgggaatagggagggggtgcggtcccagtgccgcagtgggggacccacctcacccctccagcccgaggggggacggcggcggtggcggcgaagccgggggcccgaggctgccccgggggccctgctgtacctccagatagtagaagatgaagaagagtgtctcggtcgacaggcgctggtagaattccacagtgtccgagtgtgggggtggcatctggtggtggtaggggggcgtcggacaggggttccgggggaggtactgcctgtgagagcaacaggaaggtcagtgccagctgcctactagtcctgtcgtgatcaaaagggtgctcagacatgcatccctgcggggggaggtggtacagaaagacccagggcggtgctgaccttcagtggagagcccaagtcaggggcctggtgctctacccacagcctcacaggttcagccactgcctcctccgtaagactcaagtcccagaccatcccccttccctgtggcccctcaccgaatacgctcagagtcagaggggtgaggcatgtggtgccaggcggcctcttccatggcctgctgatagagctgctccttggtgagggcacagggcccagtggacagacacccagcgacagcggtatgttcacctctgacagctgcaggggcggctgggctgaggccggaggtgctgatgtactgctcaggatgatgtctgtggggagggtgggggtccggccccctcagtggtgaggatgggtcaggggcagcccctcctctttggcccgctgcttccccaccatcctgggtccctcacctcgctcggtcaggtgcagcgttggcacagggtcctcaatgccagagctgatggctgcccgttccgccatggacttcaaggagctcagaggctcaggggcctggggaggaaacaagaggcctggcctgagcacttgggctgcaggagcaagtgcagcctgacacaggccccagatgctctcacctgccctgtttgggggccgtggagggccaacgacccactccccacaatctacccatgacaggtaaaagcatcaaactgtagggaaacaatcggagaccacgacgcattcatcagcagaggaacgtctcgtgagtgggactctgcagcatggaatactacgccgagattttcaaaatacaagttcgtgacatactacagaagtaaacgccaacctgcagaatatgtacagtgcgctaccatttttgtcaaaggatgtgccaatagtacacgctccttcactagggacacctacacgctgggagagctcccgcctgtcttgaaggaggcaggaggtctacatgctcagctgtctgcctgtgactggcatggggtgactggaatcggggtgggcccagcccggctaggcttcagtctccttgctggaaacaggtaggttgggtctccagccccgcagccacagcctcgtttcctattacaaaggttacagcaggcttctgttccccaaagtcagggctggttcctcccatctcctccagccacgtgcagctgtcccaaaccccagccctgtgctggactctccacaacgagtcagtcgccaaggcttatccatcctgtctcgctatatcgcccaggcaggtctcaaactcctgggctcaagctatcctcccgcctctgcctccctaagagctgggattacaggtgtgagccaccacgcccagctatccgtcctgcttctaaaccccactggatggctcccttccctgtcgtgccaccatgtcccacacagcccaggcctgtcctctcctgcccagaccaccctccctctatcctgtcctcaccagccccaggggacctttccaatgaagtcatgttgttccttctctactccaaaccttgccatggttcccgaccacccaccccagcgattcatttttgttgttggtggtgttaaaagatatggaccccttctgaaaatctcaaagctgctgtttccctttttccagaaaaatgcacgcactataaatatcctgtccacctacttctaaaatttgggccgggcacggtggctcacacctgtaatcccagcactttgggaggtcaaggtgggtggatcacctgaggttcggagttcaagacctgcctgaccaacatggcaaaaccccatctctattaaaaatataaaaattagcctggcgtggtggcaggcgcctgtaatcccagctactcagtaggctgcggcaggagaatcgcttgaacccaggaggcggatgttgcattcagctgagattgcaccactgcactccagcctgggtgacagagcaagactctgtctcaaaaaagaaaaaaaaaaaaaattaatgcttctgttgggccagaaactgttccaagagctttatgaggatgatttagtcttccaaataaccctacatagtaggtataatcgtgactattgccgtttcccagatgaaggcacagaaaggacaatgccaagacttggacctggacagcctgggcgcgcacactgcctcctggacagcctgggcgcgcacactgcctcctggacagcctgggcatacacactggtccccccatggaagctgcgctacagtatactggctcacaagccaagccccagctcctgaccctcgatgatcaggaccccaccgtcctatcctgctacacccactatctcagccctgcagctggtggcactgtctcctgcagagtggacacctctctcctctctgctgcatcctgcccagcttcctaagcacacaggcagatgcatgctcctcctaaagcacctcctgaagcccttcctgcagctgttagcccccctgcctggtccaggtctcagcttaaacatcaccccctctcagaccttcctgggcctgtctcccaggtcaggtcagatgcccctcggtgggcccaccgcaaccttccctgcagctgccccagcagggaagcttcctaaagggtggaaccaggctgcattcacccaaccagtctttctacttgtgcagaaagtacaccagtctatgccttgtgaggacaaacggggacagaaactgagggcctgcgggggggatgaagatggagacccagagagagcaagcaacaagtgcaaccaagagaaaggaaaagagacccagagaaacagagctttggagggaacaagagaggaggtatgagagcccccagagatcaaggtcacggggagggtggtacagaaagacctggagaaagagcaagtgtgagaaggggacagaaagccagagagagatccagaaagagggtgggggcaaggggtgcagctagagacctggaggaaagaaacaacagagtcaggacacagaggctcgggggatgtccgaggagcccaccttgatttctggggcggtgctgaactgtggaggcccattgagcagggcaccggctgccttggcatcactgaagctgggcgttggggagctgggaggattcacaggcagtggcaccaggaggctggtccccctgagttgttccctgagcctggccacgcctcnccgcccgttggtgctgccgcactgggttccttcctggagagagagcatggaagagggggttgagaggagggtccctgagggtgggatgggcagagaggcctggctggagagaggggagactgcacagatcagatgggatctgagaggggcaggtgagggcagacagatgggagaaagaagtggttctctgggcaaacaaacgcagagcccaatctttggaatggtttctcatcagcagagcagagctgtgggggtgggggtgaggattctcgggtgctccaccaggccacaggctgatcaaaaccacttgccctgggcaggtgttcacagggcccactcccccttgggcaggccagctggagctggggtgagggggcaggaagcaggcctttcctttgtgcacactgatctttcttagggcattcttcgggaaacaggcagacccagtggaatggtctgagctaagatttgaaggagtggctgcagaggaataaggacttcgggacaattcactttgaaaagtgaaacagtgaccctccggtggcagtcaattggcctcaggcaggtaacagaaatggggaggaaagggtatggggctcttgagaaaacttccacttagatgagaacgtattttagaatgttctgaagggcaaagcagggaggctgatgtagtttccttgctggaaagaagtgggggtgtaacacccgatggagatggaggatagcgcttggccattcccagcagcaagggcggggggttcagaacccaccgatgcgggggtgaggcgcctgcgcctctctgtttcaaaaggctgccatcccaaccctgccgatggccgagacactcacgaggtgctgggaggtgggttgtgggggccggaaggggggcccaaggcctggctgctggcattgttgcccccactgctgctcaaagccacctctgccgggctgtctgccacaactgagctgtaacctgggaacaaagagtaaatggaaagggctgctgcctgctgcccagccccgcccacgccccccaccccgctgcctcctcactcactggtggcgccattctgcttgccagcccctccaccggcactgctgttactactgctgctgctccctccgcctccgctgccgccgcctccgcctccgctaggctggacgctggggggccggggctgggtcgtgctgggcccactgggagctggtggggcacagcctgggcatagggagcaggggtgcccgagttgtggctgggagctggactggccttggggccagggcacttgggggtgctgcgggggcggggaaacattgttgccaggagtggtgctcaaggcagaggcagcaggcggggggccggagaggtaggtgggcggcacagctggggactgagggtgctggttgctgtggacaggcttggagccgtttttgctggagactgcgggtggagagagcagagggtcaggaccagctgggccagctggtctccctcaccacccccacctcaggctccatctttgtcccagcagcctcctctctggcctcgctgcccccacctgctcctgccctcttggggacctgggtgaccttactcaccctcatggcttcaatcaccttcatgcttaaaacactcacactgatttccagcctgcccagcttcccaagtcctgcctggacaccgccccatggacaccnccacagggatctgacacacaacttaggttgtcagccagagaagatccatctgttggaagccagaggactagtgggaaacacttaagtgttctcaatatgagattagctgagcccgcctaatgtcccaagagtaagaaggaaaaacagctggaaattggatagtaattctgaatgtcacctgaagggtcacagaagctactcacagggctggaagttaccagcactccagaaagtggtgggagggtaaatgtgctcatggtatccctaccgcaggcaatctgcggacagcactcgggctgctgagcctaaccacctcctgggcttctttccagccaccccacaggcaccttgcgcttaccaagcgcccaacaggactgactacccacttctctcctgggcatcgctgcttggcagtgggggcctgggaaggtggcagagcccagcctggcccctggagtacctgcctcagtgtctctcctcatcacctcctggccctgttgcccgccctcactactacctgcgggtccccttagtctccacaccagcctcctcaatgcccactcagggtgtccccttggaaccatccatcccgttagcccacagaggggcctcaggcccatgctgctcctgcctaacattgttctgtagcagcgtttccgaaagcgtgctcctgtcctgggagatgtcaaaggagttgaagaagcactgcccgccaccgtctcctctcagaaatttgcagtgtgtattatcagcacagcaaaggccccatcgcttcctaggcttattggactctggaggccactcaggtccacaaagcctgagcccctcagcctgacagtcccagtccctgtgctcacagttgggcccctggccctgcagacctggccagactcatctctcctcacttccaaactttctgtcacaacttgcccatgttactggctgccacctctccctgccaggcaaactcacctgactgtgaagcccagggcactccacagcagcatctcctgactgcctggccaggccaagggtgacctgtgtgctacccccttgaccacagcaccagtcacctgtccacttgccctgcccacctgccctcagggcagcactgatttctgagccacctgtgtccaccagcccagcacagtggccggcgctcaggcctcaagatgcctttgggaagcaacagaggagtgaatggcgtgcccacccggtccaggctcacacccacctggctgacttcactgtctgtggaacgtcccctcttcttatcatcttcagagttttcctgaggtaggggaggcagaatagaaacctgtgtgacctctggggctctgatggagaaccgccaatctctgaatgccccggggacctgggcccaattgactgccattgcggccccagagctggtcaaatggctgtccttaatctgcctggagaaaccatctcaattcaggctctccagtcttcttgttttctgggagccagcactgacccaccagcctcttaaggatctgggaacctgctctccacagggaagccaacccttggatccctgcccaaggtggccagctacccagcctcctcaggcagcccaggcaccggcccctcccacttcccagatccaggacctaaactggcgcgggatgcaccctattgctctttatgtcctttagggacccagatataggaccttagcgtgtgctccaagagcctagaccctggatacctagatctgtgtttcctcaattacgctcccatagccactttggagtgacccagatttgtctcctcgagtcctgccctgctggaaacacaaggtactagtgtcccgtggggcctcaccgtggtacagttggctgggctgggcgggatgggagagctggaggtggttgaggtgggcgtgctgctggactggttgaagatctcatcctccatgtggctgtggctggggggggaggtggcgaccagcgcctgtgctgtgggggcagaagaagggcatgcttagctggctcacacagcccattctgggccctcacttcctgtgccacgatcagccccagggcctcacgaatgtcctcgaggtccaggtcatcgtagagaaactcgttctcctcgaagtcggggtcctgggatgagtcaacatagtactcaacgtcgt

SEQ ID NO: 6227 - DNA, 5365 bp, Homo sapiens
gtccacgtgcggctgcgccagcgcatcatcttgtacgaattaaaggtgcgattagggagcggggtctgcaactgggtagggaccagacaggaccgggctgagataacgcacagggcctaactcggtgatggggcctccggagagatgctaagcagctccttctccaagaaaggcaggtcctggggaatgagaaggttgagaggaggccgagatagggctgcccgagctccaagcgtgtaggaaaaggatgcgccagggctgggatcggtggctaatgcttgtaaccccagcactttgggagaccgagacaggtggatcgcttcagtctaggagttcgagaccagcctgggcaacatagggaggctccctctctaccaaaaaaaaaaaaaaaaagtttgtttttttttaagtaagcacaagaagcgggcggggcctaaggcaatttggttcaaagttaagtgatgggagcggccagcagggcgtcttgatacagctgaactggaacttcaggccaggaataaagcgcagggccacctgggggcggagcctctgatgggcagggctgaccaggggcgggtcttgggatgctgggcggagcctcaggggcggggcctggggtgctgagattgaccgcggagggatgggggcttgggttgctggatccggccgcgaaggggcggggctgtaaagggccgctggtttcctggagcgggtggaaccaggactgcagaggttgttagcgggtggggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatggtgaaaaacagtctctactaaaaatacaaaaattagacgggcgtggtggtgggcgcctgtaatcccagctactcaggaggctgaggcaggagaatcacttgaacccgggaggcagaggttgcagcgagccgagatcgcaccgctgcattctaggctgggcaacagagcgagactctgtctcaaaaaaaaaaaaaaaaagaagaagaagaagaagaggccggggggaggaccttaagcttggctcctccaggaccccaagcctctactcatggtccatcccgctcccaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggtaagacacggaaatcctgctgataccgaatccagggattcaaatcctgactctgttggccaggtgcagtggctcacacctgtaatcccagcactttgggaggccgaggctgaggtcaggagttcgagaccagcctgacaaacatgatgaaaccccgtctgtagtaaaaatacgaatattagcccggcggtagtggcttctgtagtcccagctactcgggaggctgaggcaggagaatggctcgagcctgggaggtggaggttgcagtgagctgagatcgcgccactgcactccagtccgggtgacagagtgagaccctgtctcaaaaaaaaaaaaaaaaaaagaaagaaagaaagaaagaaatcctgattctgtcactgggcctcagcttcatctgtgagatgggttgaatgcgggcgcgttccactgagaagggaactgccacatggtgggtaccgggtcagggcccattctctgccttccccccttcaggaccgtgtttcttcgcctcgcctccctggtggtcctgctcttctctctctggaatcagatcacttgtgggggcgactccgaggctgaggactgcaaaacctgtggctacaattacaaacaacttccggtgagaacggcatgggtgtgcgtgggactcttgggtccctgaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagatctccccgctccccgcccttgttttagtgggttacttccctctggccccgacggcggcgacatctgggtcccttctagtcctcaggacccgccctctggacacaccccctccacgtggagtcctgaaagtcccgcccccccccccccaaccaatacgcatgcttcctattggcgggcggggcggtggaggcggggaaactccaggccgccactcccctgactccggcccggccccgccccgtccttcaggctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaaggtaaggggtaggggggacccttgggtctgaggcaggaggtattggggcccgcactcctgggtcaagggcaaggaagatcctgggggcctggattactcggtcctgagagaggagggggttggaggacagactactgcatctgagaggaggggtctagggcattctgacttatatgtctgaggatctggggactcagactccggggtcctagatgaggaaggggctcagactcctggttcggaaaaaaggagaggcaggtaggccgggtgcagtggctcacgcctgtaatcccagcacttcgggagactaaggcgggtggatcacctgaggtcaggagtttgagaccagcctggctaacatggcaaaaccccgtctctactaaaaatacaaaaaaaattagccgggcttagtggcaggcgcctgtaatcccagctactcaggaggctgaggcaggggaattgcttgaaccagggaggtgaaggtcgaagtgagccaagatcgtgccactgcactccagcctgggcgacagagcgagactccgtctcaaaaagagaaaacaaacaaacaacaacaacagcaaaacaaattagccgggagtggtggtgcacacctgtaatcccagctactcgggaggctgagacacgagaatagcttgaacccgggaggggaggctgcagtgagagccactgcactccagcctgggcgacagagcgagactctgtctcaaaaaaaaaagcctgggcgacagagcgagactctgtctcaaaaaaaaaaaaaaaaaaaatggaggcacagactcttgtgtttcagagcccttttctccgtgccttcccccaccagcttaccctcttctccacctgctccccggctgcccgcaccttccgggcctccgcggcgaatttctttttccccttggtccttctcctgggtctggccatctccagcgttcccctgctttacagcatcttcctgtaagtgcgagaggctcccgcctctctccctccctctctccccattcagtgttcagactcctggcactatgtgagcccagcctgtcttgacttcaggatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccaggtgagacggcccagacttctgggtctgggtttgaatgcgtgtgatctgggggccaccacctgcgtccaagagaggagaggcttgggcgtgggagcaggcaacgtactgagtctgagggaggaggcctaggctcctggactgctgggtccgaaggaggaggtgggcgggacgtaggactcctggatctgaaggcggaggggctgggagactgaactccttgagcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagacagacggtgagccaggcgggtccctgagagggcccctggggaacatggaaaggggttggggaagaggattgtctcacctccacctctctttgccccaggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtcctgactctcgggtgatcttccttgtatcaataaatacagccgaggttgctgagcgcgctttgaaa

SEQ ID NO: 6228 - DNA, 5360 bp, Homo sapiens
gtccacgtgcggctgcgccagcgcatcatcttgtacgaattaaaggtgcgattagggagcggggtctgcaactgggtagggaccagacaggaccgggctgagataacgcacagggcctaactcggtgatggggcctccggagagatgctaagcagctccttctccaagaaaggcaggtcctggggaatgagaaggttgagaggaggccgagatagggctccccgagctccaagcgtgtaggaaaaggatgcgccagggctgggatcggtggctaatgcttgtaaccccagcactttgggagcccgagacaggtggatcgcttcagtctaggagttcgagaccagcctgggcaacataggggggctccctctctcccaaaaaaaaaaaaaaaaagtttgtttttttttaagtaagcacaagaagcgggcggggcctaaggcaatttggttcaaagttaagtgatgggagcggccagcagggcgtcttgatacagctgaactggaacttcaggccaggaataaagcgcagggccacctgggggcggactctgatgggcagggctgaccaggggcgggtcttgggatgctgggcggactcaggggcggggcctggggtgctgagattgaccgcggagggatgggggcttgggttgctggatccggccgcgaaggggcggggctgtaaagggccgctggtttcctggagcaggtggaaccaggactgcagaggttgttagcgggtggggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatggtgaaaaacagtctctactaaaaatacaaaaattagacgggcgtggtggtgggcgcctgtaatcccagctactcaggaggctgaggcaggagaatcacttgaacccgggaggcagaggttgcagcgagccgagatcgcaccgctgcattctaggctgggtaacagagcgagactctgtctcaaaaaaaaaaaaaaagaagaagaagaagaagaggccggggggaggaccttaagcttggctcctccaggaccccaagcctctactcatggtccatcccgctcccaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggtaagacacggaaatcctgctgataccgaatccagggattcaaatcctgactctgttggccaggtgcagtggctcacacctgtaatcccagcactttgggaggccgaggctgaggtcaggagttcgagaccagcctgacaaacatgatgaaaccccgtctgtagtaaaaatacgaatattagcccggcggtagtggcttctgtagtcccagctactcgggaggctgaggcaggagaatggctcgagcctgggaggtggaggttgcagtgagctgagatcgcgccactgcactccagtccgggtgacagagtgagaccctgtctcaaaaaaaaaaaaaaaaaaagaaagaaagaaagaaagaaatcctgattctgtcactgggcctcagcttcatctgtgagatgggttgaatgcgggcgcgttccactgagaagggaactgccacatggtgggtaccgggtcagggcccattctctgccttccccccttcaggaccgtgtttcttcgcctcgcctccctggtggtcctgctcttctctctctggaatcagatcacttgtgggggcgactccgaggctgaggactgcaaaacctgtggctacaattacaaacaacttccggtgagaacggcatgggtgtgcgtgggactcttgggtccctgaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagatctccccgctccccgcccttgttttagtgggttacttccctctggccccgacggcggcgacatctgggtcccttctagtcctcaggacccgccctctggacacaccccctccacgtggagtcctgaaagtcccgcccccccccccccaccaccaatacgcatgcttcctattggcgggcggggcggtggaggcgtggaaatccaggccgccactcccctgactccggcccgccccgccccgtccttcaggctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaaggtaaggggtaggggggacccttgggtctgaggcaggaggtattggggcccgcactcctgggtcaagggcaaggaagatcctgggggcctggattactcggtcctgagagaggagggggttggaggacagactactgcatctgagaggaggggtctagggcattctgacttatatgtctgaggatctggggactcagactccggggtcctagatgaggaaggggctcagactcctggttcggaaaaaaggagaggcaggtaggccgggtgcagtcgtcacgcctgtaatcccagcacttcgggagactaaggcgggtggatcacctgaggtcaggagtttgagaccagcctggctaacatggcaaaaccccgtctctactaaaaatacaaaaaaaattagccgggcttagtggcaggcgcctgtaatcccagctactcaggaggctgaggcaggggaattgcttgaaccagggaggtgaaggtcgaagtgagccaagatcgtgccactgcactccagcctgggcgacagagcgagactccgtctcaaaaagagaaaacaaacaaacaacaacaacagcaaaacaaattagccgggagtggtggtgcacacctgtaatcccagctactcgggaggctgagacacgagaatagcttgaacccgggaggggaggctgcagtgagagccactgcactccagcctgggcgacagagcgagactctgtctcaaaaaaaaaagcctgggcgacagagcgagactctgtctcaaaaaaaaaaaaaaaaaaaaatggaggcacagactcttgtgtttcagagcccttttctccgtgccttcccccaccagcttaccctcttctccacctgctccccggctgcccgcaccttccgggcctccgcggcgaatttctttttccccttggtccttctcctgggtctggccatctccagcgttcccctgctttacagcatcttcctgtaagtgcgagaggctcccgcctctctccctccctctctccccattcagtgttcagactcctggcactatgtgagcccagcctgtcttgacttcaggatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccaggtgagacggcccagacttctgggtctgggtttgaatgcgtgtgatctgggggccaccacctgcgtccaagagaggagaggcttgggcgtgggagcaggcaacgtactgagtctgagggaggaggcctaggctcctggactgctgggtccgaaggaggaggtgggcgggacgtaggactcctggatctgaaggcggaggggctgggagactgaactccttgagcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagagagacggtgagccaggcgggtccctgagagggcccctggggaacatggaaaggggttggggaagaggattgtctcacctccacctctctttgccccaggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaaa

SEQ ID NO: 6229 - DNA, 2811 bp, Homo sapiens
gttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaataaaaaataaaaaatggataaatcttttctttttgcctttttgccctag

SEQ ID NO: 6230 - DNA, 4723 bp, Homo sapiens
gggatctgttcgattcaggctttcacccttttactgccttacagattgctaatatacattctccattggtcttttaatgtcgtttacagaagctgactctctaccgcctccttctctccgtctcaccctctctgcctcgcctgctctgtactgttctgttctcttctctctctccctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataaatcttttctttttgccttttggccctaggatcgtgtttaggaggattatcccaccccgagattatataaatcttatcctatatttctctaacttatatggttttatttagaaaatgttttgtcctgtctggaattatcttgatgtatggatttaggtattctaacttttttgccccaaagggttagccagttgttaacatatttaccttttcccccaacatatgaaatgtcatacatgtatatactttattctgtgtttggattccctttagttccattgaacattgtggcaccagtacaccagcctgtagatgagttagaaatgggactttgtatcttttaatgtgagacctcctcttgatcttttttattttttacaatattctgacgattctgacatgtttattttaccagatgaattttacagttaatagattcttcccccaaaaatatattgagaatttggttgggattctcttaaattgatatgactgtgaggactacagaattgcattgctttccagaaacatgttgccttgtttctgaaaaactttatatatccttcaagagagttttacttaaatcctatataatttgtaataaatatgttcctaggtaatacagacatacagggaacacgttgatactgcttattggagcttttaatatgttacctatgtggtcatttttgctatataggagaagaatttatttgcatcgattattttaaattggcaatttattgaaatctattaattttagagatattcatttgatccttttgagtttttccaggtgagaaatcctatcaattatgttataattatatgttttccttttcaaaatttataacataatttctgactgcatgggttaaacattttcataacagtgctaaataataaaggtggcaggggcatttttgtcttgtttctcattttagccagaatgtgtttgctacagcaattccaaattgtgttttgtgaaaaaaaaatattcttctgggagacaaggaaatacatttgcaa

SEQ ID NO: 6231 - DNA, 4045 bp, Homo sapiens
cggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataatcttttctttttgcttttggcctaggatcgtgttaggaggattatcccacccgacgataatataaatcttatcctatatttctctaacttatattgttttatttagaaaatgttttgtcctgtctggaattatcttgatgtatggatttaggtattctaacttttttgccccaaagggttagccagttgttaacatatttaccttttcccccaacatatgaaatgtcatacatgtatatactttattctgtgtttggattccctttagttccattgaacattgtggcaccagtacaccagcctgtagatgagttagaaatgggactttgtatcttttaatgtgagacctcctcttgatcttttttattttttacaatattctgacgattctgacatgtttattttaccagatgaattttacagttaatagattcttcccccaaaaatatattgagaatttggttgggattctcttaaattgatatgactgtgaggactacagaattgcattgctttccagaaacatgttgccttgtttctgaaaaactttatatatccttcaagagagttttacttaaatcctatataatttgtaataaatatgttcctaggtaatacagacatacagggaacacgttgatactgcttattggagcttttaatatgttacctatgtggtcatttttgctatataggagaagaatttatttgcatcgattattttaaattggcaatttattgaaatctattaattttagagatattcatttgatccttttgagtttttccaggtgagaaatcctatcaattatgttataattatatgttttccttttcaaaatttataacataatttctgactgcatgggttaaacattttcataacagtgctaaataataaaggtggcagtggcatttttgtcttgtttctcattttagccagaatgtgtttgctacagcaattccaaattgtgttttgtgaaaaaaaaatattcttctgggagacaaggaaatacatttgcaa

SEQ ID NO: 6232 - DNA, 11138 bp, Homo sapiens
cggaggcagagtaagaagactcagtaccgggaataccttgacttcattaaagaagtgggcttcacctgtgggtttcacgtggacgaagactgcctcaggattccttcaaccaaaagagtatgtctgattctcatgttgttctaggcggtgtgtcggtgttcagatggagagctcagggctctgccacagagccatgaaccatgctgtaacgttcaaaatgttctagaacgtgccggtgctgatttctgtgcctctgtcactgatgaggcccagaggcttgttctgtcccatggtgccctccttaaaggcacccggtgctccctcctccaggcctgcaggagtcctcgccaagccctccttgcctctccagaagctctgagtggccccaggggacctgcccagaggaggcctcagtgtggcctgtggctgacctccctgtggaaagttcctgctccttcaagtcgcagataattggctgcgattgaagtgtgtttcagaagttcacagtgatttcccattttctcattaaaggcctagttcattcagattcacctgaaatgtcatttgggcagaagttggcccgggggctttctgtaagcagtgggactgtgcctctgacctttgtgtggacagggcagacttatgccctcttgccgctccaaaggcttgaccttttgaaagtaccgtggaagtgtttacagcagctcacctatgtctctggtaactttatttgacaagactgtggctggcagacagtgtgcttttaaaaaataaccccgtcgtgtccaggccacagaatttgatggctgccttagcaagaaagggcccagctgatctgagtgaagcctcggctctgctgctgcccgtggtgcactcgggctgatcgcggagctccgctaagcctgtcctcacctgtgagaccaggaggaggctgcccgggtctctgtgggggctggacaggatgatgtcttcagagcccacagcggggagggcatgttgtgggcactcgctggccggctgccgtcatagccgtgcaccaggagcagcgttggcttgtggcacaggcctcagggccgctggcgctgtcactgccctgctaccgtgggaagttaccttaggactcgctgctgaaccgtcccgtcatcctctgtgtcctctgtttttggcaagtcttggtcttctgagttcagaattgatttggggaaactgctaaagtttgggtcctctaggcgggtccgaggagcccgtggctttgatttttgcacttgcttctccattactaattggtagagaccgtggactgtcgcttcatctctctgagcttcagttttcttatcactggcaggtttggggatcgaatgtaagagtggatgtgaacgtgctttgtcatttttaaagcagttcacacacagcacatgtctggtggggactgggtgtgtgacaggcactgagaatttaaaatcccgctggaagagctggggagcagaggtgtggctgtcacgtagtgaggaggtcggcttccttatcacccgcgcctggccttgtagttgatgcctggagaggaagcccagaaatgaggtgcccttgctggggctgggcagggcctggttgtccggaggggactgtctgaagggcaccctccatcggggtgtgcggcaaagggaggcaagcacgcatggagcacctctatggctccaggccctctgcgcagcccccgtatgcactcgctggctctggcaaggtggggacaaagctgcctcccttcccagcccctggggcactctgcaactctgcagcgttaccatcagcatgtgcccccgccgggcggccgaggggtggaatgaggggcggcagcgggaaactaggacggtgcggctgccgggcccaggagtgtggactcttgagtttaggcgcctttgttagatcttgtgaaggtccaagatctaacaatgatgagagggaaccatgggctcttactgtttttttaatttttaagttacttatattggtgtcagtttttattttgtatttatttttattgatttatttattttgagatggagtttttgctcttgtcacccaggctggagtgcattggcacaatcttggctcactggcctctgcctcctgggttcaaatgatcctcctgcctcagcctcctgagtagctgggactacaggtgagggccaccacgcccggctaatttttgtatttgtagtagagacgggattttgccatgttggccaggctggtctgaaactcaagtgatccgcctgccttgggctcccaaaatgctaggatgataggagtgagccaccgtacctggctggtgtcagttttttaaatcaggattttttcatgatagacattgaaaacttgtgatttgtactccaggatgagagaattccatggagaacgttgaaatagactagccagctaaaatacttgctttgctttcttcaaacgcaggtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggaggtaagctgtccaccatcttagggaggggctagcacgctcccaggcttgagggcaggaattcacgtcttcagaaccgacatgaaatggtgtggccctgtgactacacactttgaaaaagccattgatggtgggtgcataggctctcttcaagcaaattctttaaaattttccaaatagctcttataaacataaaggactttgttatttccagggagtgacagagtttggacccttaattaacttttaccaaacatgcaggtttaggggctagaactactcattttcaatctagaaattatccaaagagaaaacaggttactgagtgcaagcaaaatgcactgtccccttgagtatgtggtaagatttggagctgttgtgattcgataatttaattctctttgaaatccccaaaacacaacaatcatccatggcaaaaggagaaaattacatcgattgttctcatggggtgagtggtgtgctgaaattatgttctcaggtgagtggtgtgttgaaattaacggcattcagagagccagccagggctgtaaggacctcgcctccttccgggcagggatgctgcttggccgccagagggtggtgtagagctgcagccaacgcctggcttctcttgcagttttgggaactggagaagagcacggagccccatcccctcccggcccctccgtcggtgacttctgcctggctgcgcatttgagggaaacccttcttctccaggctttgctttcctcacctatgaatgttgggacaaaatcatacccgtttccttcttcatcctttgtcctcttgtaccatgtgtacgtgggatgggaccgggccatggagcatagacggcccctccagaaatcattcgaacctgatggtacctggtcagcagagcctctagccatctggcgagagtggccctggctcagtggctgatggggccgactagctgcaaaccaccaggcaccgtggggcctctgggttggccctgctgactaaaggcaccctgctgtggtggggctggagcacagaggaagaaggctgaggctggcagagcatggagcccaccacaggcaactgggacccagagccccagggacatcagtgtggtctgaaagttcccacgtgcagtaaacagtgacagttcttgagtgcagtttgacctttaaattcccaggagatgacgggcacacagatgtcagctgtgcctgggatggacggctttcggtgggtgaggaggaaggaggaacagacctggagatggagagcggggatgggtgagcggtgggctcagtcctgcctgcgccttggaacttgggaatcagggcacctaacaggctctggacccccgtcccctccagatgggtgtccgtgggtctggggcttgttagggactctccacgtggccttggcctctcagcccactgcctccctcccgcccacaggcggccttcagggcctttggtcgcccccacccagcctgtcctcaggcaggcacctctgcgtttctgtgcctgtgggccatgtgtggctctgtctccaggacctcacccatcctagctcggcgtctgtccctgtgggacactgctgagaaatagggtaggaaagggccctgccctcaagaggctccaagtcctgcctggctaggagtcaagaccgcacacgtcaaaggatgagaaaccaagaggccggatatgccaggccaggaggcacccatggctgagtgtgagattccctgttatggagtccatgctgggccagagccggggcaacagggaaggctgactgggacaatatgtgatcttttttaaaacactcccgctcctctcagaatggatttgagacagccgagaggtggactcagaaggttggccaggctgggtgggcaggattctcgcagcagctgcgacagcggctgccagcaccaggctcctgggtcaggagtgtggtgtcctgatccgtaggggtctgacaggctcagctgcatacagacaggcgccgtctcctccgctctcctgcagcttgggagggtgtggataagatgtgaggtgcagcacctggcagataggaagttcctggcaaatacatgcaggaaaaccagctttcattcatatccaatttgatgttttggtaataaatgactttaatgtcaccaggttttctgattagagcattttgaaatacctgcaggctctcaaagcagaaattcgaatgggaaagagaccatcactgtggtgtctgtgctgttcctttttttagtgcctagcatggccttgctggccaccctagagccggtagcgccagggctggctgccccatggttggagcagccactgggaaggctcaggccccaggcttgccagcttggccttccttctttagtctgagaaaccctggctccaaacagccaccccccttcatgggtcaccagtgagaagagcttgaggtgaccacccagagcaggcagcatcacctgacgcctggccctgtgcgggcatggggcatgtgtggggctgcgtcttgtcaggctgtgccaccttagctgggtggggacgccacggccctcacggtttggtgcggtgtggtgtgggttaggtgagatggaatcgtccttcgtgctggagtgcataacgcgtgtgagtgtatggaactgaaatggactgtttctgcctgtgtgacaggttcgtaatattttgctgttgttttggggaaaaaaaaaacccgtttttccacagagagcctatctctggcagaagtagccaacgagctggacacggagaccctgcggaggctgaagcgggagtgtgggggcctgcagacgctgctccggaacagccaccaggtgttccaaggtacggagtccgcctctcccccgccgttctttccttctttttcccccttttttcagttaaataatgttttattttagagtggtttagactcactgaagaatctgacagaagcagcaagttccgcggtgccccacccagctctgacgtgggtggcatttgacctcagggtgggacgtgggtcaccccgttccctccttgctcctctggacctcgtcccatgcgatgtccccaggctggtctctctccccctatgctgtgcttgctgacgcctcagctccacttgctccacgcaggacagagcaagtcgggtagccgctggccggtcccctgttggctgggggtcattgtttggcgtcatctttagctgctgcaaactgaaagcatcctgagccacagagccagggtggggagtgggaagagtgagccctgccccacaggcggaggcctggactcctgtggccctcgccccacgggcctgggcaggcggaggtcctggtacccagttcccctgctccccaacgccctgtgactccaggactgccagggtatggggaggcaggagggccctccacccgcttgtccattcactcagcccgcaaagcaaggcagacacatccctggccttctggagccggtggtgcagtgagggaggggggagatgtagcaggtgctcacccaggtgccagtggtgtacacacttccatcatctgcagcttccaggtgtgcacagagggggcaggaacagggcagggagccatggtttaccagcgccagcggctggggagtttgccataacttgctttgtggcgctttttttttttttttcctctttctgtaagtattttaaagcaaattctagctagcatgctatttcacccctaagtacttccacgtgcatctttaagaatagtaggtgtcttcttgtgtcaccaccatgccctaagcacacatttctgtgagttgtgatgtgcagggagaactggcctggcccgagtgggctcaggagggctttacttaggaaatgacacttgagctgggcctggaaggaaaagaggagtcaggaacagagaacagctttaggcagagcgaacagcatttgcaaagagccagggttgggaggagtaagagtgggagctggtcgggttacagccgccatgaccaggaaaaggactgggcctctgatgggtagggatgacaccgaagtcacagtgggaaggagtggcctggcttacaccctagcttctgggtcccctgcccatgaagtagccgtggggatcaggtgcagtacagtgtctggctctctgggtgtgtgagagagcacaggtgtgtgtgccattcctcatgtgtacacaagagtgcaagcgtgtgggtttgtgcacacacacacactgcctttgtgtgcctgcctgctcctggagagctgaacttggctttcagctgaactggcctctctaggtgagagctgctgttgggtggggggccggtgagcatggttggagcctgtgtttctcggggcaggcgcagaagcgtgtccctgaggctgcccccagagtagacactgggcctgcagtgctggctgggctgggcctgctggctgggctgggcctgctgcctggagtctgctcttccttgcatagagctttaggcagttagaatacttcccacctccacggggcctctttctgtctttcccaacacttgtttttgttggtttcctgaaatactgtctttttcacccatgatgagtctgcttgtatgtcagtgtttttctgtgcaggtcaccctgggggggcaaacttgtttttggaaacgcttctgagtaggaggcctgggaattgggttccaaataaacattctcctccagtcatgcgaaaactatgctctgaagctgggtcttatctctgtatgaggtttaggttttgttttaagctaacgtggctagtctcagaaaatgtttatgagagtgaggaattggaaatgtttccagatggcttcaggtcagccagccctgagcatgacccatgagggccacaagggccagccctgcctctgtccctgccccttcctgaggccgccaaggggcggcacgctgcatccatgctggctggtatggagcctggcaccgtgctgccgggtacacgcggggcctcatctcatcctgcactcatggcagagcaggcctttcctccttgaacatgtagacaagtctcagagaggtcagtgcgccggcccgatgtctcccagtgagtggagaggccacgccacagtccgggccaggtctgacccagcactggcacccctgagcctatggcatcatccgaggactgtaatcctcaacccgttcctcagagcaacttggtgaaagggagtgtctgtctgctgtcagaagcagtggtggagatggcggctcctgtgctgaggtagagtcccaggggatgcgcacggtaaggagggaggaggcggcaggaacttgggtggagcagactgtggctctgtggttccatttcaaaatgaggagcacatttccagaggaggagagtctttctagctgttggttgtctttctagctggctagagcaagtgcctctggaaggccgccccttctggcacctggccagatgggggctcaggtgttaagaggggcggccgggagctacctgccatgtccagggttgtagacacggggagtgggtcagtgaggctgggccagcctggagcctgcctgcgccgttcgggagcctcatctctatcatcagcgcccgctcctcagtccttagacaccctgcaggtcctgcttccaaaacatggttgggtgtgctcttaactccggagccgcgtgggagggcctgccgccagctggcctgtcacgttgtggtggggaagggggtgccgaggctggctctgaggggaatctgtactcagcctttggcctcagtgatcccccaccccccattctcttgacaggtcagggcatcaggccagaggcccctcactgtttgggatcatggggagttggggggaagctctggcccctggggctcctcctgagcaccctttagagggttccaggtccctcagtggccaggatgtgcccttctgtgctgcgccaggaggtgctgctgtggggacatgggcagagtgtcgcgggactgccttaacaggagacttcaggttaagaaacctcagctccaatgttgggaggcgagacagagaggcagccgtgggagggcaaacagggtcaggcctggccttggcggtgcttccagccaggctgtgagggtgagcccccaactgtggcgccgttctctgggctcatttctctagtttcaggggaaactgtaaaacatcagtctgtcaaaagcacacaggctcgttattgccacacacaaggtgatttgaaggcagaattcgagctttaattcctacactttcaagttctctttggaagtcggtgagccagacttcctcactgaggctcctttattcccccgagccttctgtcgtgagcggtttcctagcttccagcgagaaccaggaaggaggtggttgctttggccatgtttcacggggagttgttggattcccacaaggaaacggccaaatgggagcgtaggggggtatctcggcccaatttgggcggcggggtcaggaggcagcctagaggaggcctgcgaggcctgggacccaggtgacgagcgggcccacagcagccctctcctggccccaccccactctgatgtccctccagctccccagtttggagatcagccctggccattgggtcccagtggcactttcagagggggtatctaaactactgcacataggcaggtcccccttcgtgttcctgttccagagctcattggcctctgttactccacacttgcacctggaggggctccggttgggaggcgcatgtaaacccagtgcaccgggacggcaccaaggagcagaggctgccctgcaccagccccgtccttagactgcgtggagggacctgcgccttgcccctctttctgcccgtaatgctgacacagtcctcagaggtcggggctgcagcacagatgttttctcgtgtttcggctctcacaccgtggtccctccttcctccactcaagtgatccttctaaaatggtggctctgcaggacctgcctctcagccagagggaaggtcggtggcctcaatgatgaggccacaagggacccagctctgtcctctgccctcccctctggctgtccctcgaatgtggccagtcctggtgcagtctgtcctgggacactcgggtttgctgctgctttgcctaaaatgctcttcctgggtctgcgcagggctgccgctcacttcccgcagggctcaccttccccggccttgcctgaagacacatcccatacctcagtcactcccactggaggcagactcactgtgaccagcaggaactctaggctgtgttccggttgtatccctgaccctggattggcacctcccgtggcgtgggagctaaagagaggctggtgaattaaggaactttcaggtttacttctcagtgtgtcttctctgttccaaaccacagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctgacatgggccactctaagtggcatgaaa

SEQ ID NO: 6233 - DNA, 8571 bp, Homo sapiens
ccctgtaagcccacctggctgggagctttccccttctccacgctgggttgctgctggcagtgctggtcactgtgacggtcagcaagctctggacgccagggtcgggtgtgtaacagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggaggtaagctgtccaccatcttagggaggggctagcacgctcccaggcttgagggcaggaattcacgtcttcagaaccgacatgaaatggtgtggccctgtgactacacactttgaaaaagccattgatggtgggtgcataggctctcttcaagcaaattctttaaaattttccaaatagctcttataaacataaaggactttgttatttccagggagtgacagagtttggacccttaattaacttttaccaaacatgcaggtttaggggctagaactactcattttcaatctagaaattatccaaagagaaaacaggttactgagtgcaagcaaaatgcactgtccccttgagtatgtggtaagatttggagctgttgtgattcgataatttaattctctttgaaatccccaaaacacaacaatcatccatggcaaaaggagaaaattacatcgattgttctcatggggtgagtggtgtgctgaaattatgttctcaggtgagtggtgtgttgaaattaacggcattcagagagccagccagggctgtaaggacctcgcctccttccgggcagggatgctgcttggccgccagagggtggtgtagagctgcagccaacgcctggcttctcttgcagttttgggaactggagaagagcacggagccccatcccctcccggcccctccgtcggtgacttctgcctggctgcgcatttgagggaaacccttcttctccaggctttgctttcctcacctatgaatgttgggacaaaatcatacccgtttccttcttcatcctttgtcctcttgtaccatgtgtacgtgggatgggaccgggccatggagcatagacggcccctccagaaatcattcgaacctgatggtacctggtcagcagagcctctagccatctggcgagagtggccctggctcagtggctgatggggccgactagctgcaaaccaccaggcaccgtggggcctctgggttggccctgctgactaaaggcaccctgctgtggtggggctggagcacagaggaagaaggctgaggctggcagagcatggagcccaccacaggcaactgggacccagagccccagggacatcagtgtggtctgaaagttcccacgtgcagtaaacagtgacagttcttgagtgcagtttgacctttaaattcccaggagatgacgggcacacagatgtcagctgtgcctgggatggacggctttcggtgggtgaggaggaaggaggaacagacctggagatggagagcggggatgggtgagcggtgggctcagtcctgcctgcgccttggaacttgggaatcagggcacctaacaggctctggacccccgtcccctccagatgggtgtccgtgggtctggggcttgttagggactctccacgtggccttggcctctcagcccactgcctccctcccgcccacaggcgccttcagggcctttggtcgcccccacccagcctgtcctcaggcaggcacctctgcgtttctgtgcctgtgggccatgtgtggctctgtctccaggacctcacccatcctagctcggcgtctgtccctgtgggacactgctgagaaatagggtaggaaagggccctgccctcaagaggctccaagtcctgcctggctaggagtcaagaccgcacacgtcaaaggatgagaaaccaagaggccggatatgccaggccaggaggcacccatggctgagtgtgagattccctgttatggagtccatgctgggccagagccggggcaacagggaaggctgactgggacaatatgtgatcttttttaaaacactcccgctcctctcagaatggatttgagacagccgagaggtggactcagaaggttggccaggctgggtgggcaggattctcgcagcagctgcgacagcggctgccagcaccaggctcctgggtcaggagtgtggtgtcctgatccgtaggggtctgacaggctcagctgcatacagacaggcgccgtctcctccgctctcctgcagcttgggagggtgtggataagatgtgaggtgcagcacctggcagataggaagttcctggcaaatacatgcaggaaaaccagctttcattcatatccaatttgatgttttggtaataaatgactttaatgtcaccaggttttctgattagagcattttgaaatacctgcaggctctcaaagcagaaattcgaatgggaaagagaccatcactgtggtgtctgtgctgttcctttttttagtgcctagcatggccttgctggccaccctagagccggtagcgccaggctggctgccccatggttggagcagccactgggaaggctcaggccccaggcttgccagcttggccttccttctttagtctgagaaaccctggctccaaacagccaccccccttcatgggtcaccagtgagaagagcttgaggtgaccacccagagcaggcagcatcacctgacgcctggccctgtgcgggcatggggcatgtgtggggctgcgtcttgtcaggctgtgccaccttagctgggtggggacgccacggccctcacggtttggtgcggtgtggtgtgggttaggtgagatggaatcgtccttcgtgctggagtgcataacgcgtgtgagtgtatggaactgaaatggactgtttctgcctgtgtgacaggttcgtaatattttgctgttgttttggggaaaaaaaaaacccgtttttccacagagagcctatctctggcagaagtagccaacgagctggacacggagaccctgcggaggctgaagcgggagtgtgggggcctgcagacgctgctccggaacagccaccaggtgttccaaggtacggagtccgcctctcccccgccgttctttccttctttttcccccttttttcagttaaataatgttttattttagagtggtttagactcactgaagaatctgacagaagcagcaagttccgcggtgccccacccagctctgacgtgggtggcatttgacctcagggtgggacgtgggtcaccccgttccctccttgctcctctggacctcgtcccatgcgatgtccccaggctggtctctctccccctatgctgtgcttgctgacgcctcagctccacttgctccacgcaggacagagcaagtcgggtagccgctggccggtcccctgttggctgggggtcattgtttggcgtcatctttagctgctgcaaactgaaagcatcctgagccacagagccagggtggggagtgggaagagtgagccctgccccacaggcggaggcctggactcctgtggccctcgccccacgggcctgggcaggcggaggtcctggtacccagttcccctgctccccaacgccctgtgactccaggactgccagggtatggggaggcaggagggccctccacccgcttgtccattcactcagcccgcaaagcaaggcagacacatccctggccttctggagccggtggtgcagtgagggaggggggagatgtagcaggtgctcacccaggtgccagtggtgtacacacttccatcatctgcagcttccaggtgtgcacagagggggcaggaacagggcagggagccatggtttaccagcgccagcggctggggagtttgccataacttgctttgtggcgctttttttttttttttcctctttctgtaagtattttaaagcaaattctagctagcatgctatttcacccctaagtacttccacgtgcatctttaagaatagtaggtgtcttcttgtgtcaccaccatgccctaagcacacatttctgtgagttgtgatgtgcagggagaactggcctggcccgagtgggctcaggagggctttacttaggaaatgacacttgagctgggcctggaaggaaaagaggagtcaggaacagagaacagctttaggcagagcgaacagcatttgcaaagagccagggttgggaggagtaagagtgggagctggtcgggttacagccgccatgaccaggaaaaggactgggcctctgatgggtagggatgacaccgaagtcacagtgggaaggagtggcctggcttacaccctagcttctgggtcccctgcccatgaagtagccgtggggatcaggtgcagtacagtgtctggctctctgggtgtgtgagagagcacaggtgtgtgtgccattcctcatgtgtacacaagagtgcaagcgtgtgggtttgtgcacacacacacactgcctttgtgtgcctgcctgctcctggagagctgaacttggctttcagctgaactggcctctctaggtgagagctgctgttgggtggggggccggtgagcatggttggagcctgtgtttctcggggcaggcgcagaagcgtgtccctgaggctgcccccagagtagacactgggcctgcagtgctggctgggctgggcctgctggctgggctgggcctgctgcctggagtctgctcttccttgcatagagctttaggcagttagaatacttcccacctccacggggcctctttctgtctttcccaacacttgtttttgttggtttcctgaaatactgtctttttcacccatgatgagtctgcttgtatgtcagtgtttttctgtgcaggtcaccctgggggggcaaacttgtttttggaaacgcttctgagtaggaggcctgggaattgggttccaaataaacattctcctccagtcatgcgaaaactatgctctgaagctgggtcttatctctgtatgaggtttaggttttgttttaagctaacgtggctagtctcagaaaatgtttatgagagtgaggaattggaaatgtttccagatggcttcaggtcagccagccctgagcatgacccatgagggccacaagggccagccctgcctctgtccctgccccttcctgaggccgccaaggggcggcacgctgcatccatgctggctggtatggagcctggcaccgtgctgccgggtacacgcggggcctcatctcatcctgcactcatggcagagcaggcctttcctccttgaacatgtagacaagtctcagagaggtcagtgcgccggcccgatgtctcccagtgagtggagaggccacgccacagtccgggccaggtctgacccagcactggcacccctgagcctatggcatcatccgaggactgtaatcctcaacccgttcctcagagcaacttggtgaaagggagtgtctgtctgctgtcagaagcagtggtggagatggcggctcctgtgctgaggtagagtcccaggggatgcgcacggtaaggagggaggaggcggcaggaacttgggtggagcagactgtggctctgtggttccatttcaaaatgaggagcacatttccagaggaggagagtctttctagctgttggttgtctttctagctggctagagcaagtgcctctggaaggccgccccttctggcacctggccagatgggggctcaggtgttaagaggggcggccgggagctacctgccatgtccagggttgtagacacggggagtgggtcagtgaggctgggccagcctggagcctgcctgcgccgttcgggagcctcatctctatcatcagcgcccgctcctcagtccttagacaccctgcaggtcctgcttccaaaacatggttgggtgtgctcttaactccggagccgcgtgggagggcctgccgccagctggcctgtcacgttgtggtggggaagggggtgccgaggctggctctgaggggaatctgtactcagcctttggcctcagtgatcccccaccccccattctcttgacaggtcagggcatcaggccagaggcccctcactgtttgggatcatggggagttggggggaagctctggcccctggggctcctcctgagcaccctttagagggttccaggtccctcagtggccaggatgtgcccttctgtgctgcgccaggaggtgctgctgtggggacatgggcagagtgtcgcgggactgccttaacaggagacttcaggttaagaaacctcagctccaatgttgggaggcgagacagagaggcagccgtgggagggcaaacagggtcaggcctggccttggcggtgcttccagccaggctgtgagggtgagcccccaactgtggcgccgttctctgggctcatttctctagtttcaggggaaactgtaaaacatcagtctgtcaaaagcacacaggctcgttattgccacacacaaggtgatttgaaggcagaattcgagctttaattcctacactttcaagttctctttggaagtcggtgagccagacttcctcactgaggctcctttattcccccgagccttctgtcgtgagcggtttcctagcttccagcgagaaccaggaaggaggtggttgctttggccatgtttcacggggagttgttggattcccacaaggaaacggccaaatgggagcgtaggggggtatctcggcccaatttgggcggcggggtcaggaggcagcctagaggaggcctgcgaggcctgggacccaggtgacgagcgggcccacagcagccctctcctggccccaccccactctgatgtccctccagctccccagtttggagatcagccctggccattgggtcccagtggcactttcagagggggtatctaaactactgcacataggcaggtcccccttcgtgttcctgttccagagctcattggcctctgttactccacacttgcacctggaggggctccggttgggaggcgcatgtaaacccagtgcaccgggacggcaccaaggagcagaggctgccctgcaccagccccgtccttagactgcgtggagggacctgcgccttgcccctctttctgcccgtaatgctgacacagtcctcagaggtcggggctgcagcacagatgttttctcgtgtttcggctctcacaccgtggtccctccttcctccactcaagtgatccttctaaaatggtggctctgcaggacctgcctctcagccagagggaaggtcggtggcctcaatgatgaggccacaagggacccagctctgtcctctgccctcccctctggctgtccctcgaatgtggccagtcctggtgcagtctgtcctgggacactcgggtttgctgctgctttgcctaaaatgctcttcctgggtctgcgcagggctgccgctcacttcccgcagggctcaccttccccggccttgcctgaagacacatcccatacctcagtcactcccactggaggcagactcactgtgaccagcaggaactctaggctgtgttccggttgtatccctgaccctggattggcacctcccgtggcgtgggagctaaagagaggctggtgaattaaggaactttcaggtttacttctcagtgtgtcttctctgttccaaaccacagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctgacatgggccactctaagtggcatgaaa

SEQ ID NO: 6234 - DNA, 453 bp, Homo sapiens
agccatccttctgcctcagcctgtcaagtgactgggactgtagatgcacgccaccatgcctggccaacttttaaaattttagaggcggggtctcgctatgttgcccaggctggccttgaactcttgggttcatgcagtcctcccacctcagcctcccaaagtgctggcatgacagctgcgagccatggcgtctgacccccgatgtttctatttaaagttatttctatggttttatacaaaaggtcacatgcagtccacactgttctgccgttgactttctgcagtgtaccctggtgcctctccattgggtatatctgcctgattattggcagcagccgtgtggcattccgtggcagcgccgcactcatcacacctgagcagtgagaataaatgggcatcttctctgaaggcacctcagctctgcagcaccacggggcggcgctgccacgggcc

SEQ ID NO: 6235 - DNA, 453 bp, Homo sapiens; identical to SEQ ID NO: 6234

SEQ ID NO: 6236 - DNA, 27968 bp, Homo sapiens
caggagaacctcatgctttccatcctgcccaagcacgtggctgacgagatgctgaaagacatgaagaaagacgagagccagaaggaccagcagcagttcaacaccatgtacatgtaccgtcacgagaacgtcaggtacgccggcccggggcgcgggctctgatggcagagcaggctgtggagggctgcatctttgtgggacccgctaggtgctgtgggcttcaagaggttttccagggactagaagcaaggcctcccacagcattcatcagcctggcggaggaagctgccagcagatgttgaagctacagtgtgctctaggctgcttggtccaaccccatcatagaacagatatcacctggagcggggaagggactcctgtgaggtcacccagctgttgagggccagcactggggctagagccctgacctgtgattctaggaagaaggatgagttcagcctgggcaggagtgggcagtgtggggtggtccccaggcaccacagggagggaggcctgcaggggaagtctgctaggacaagtgcaaggtcagagccctgactttacctggaagggtcagggtctcactgtctgggggtcgtgagggaggaccttctcctgccctgatcctggctgccctgtgggttggagagggagctggcagtggggtcgggtacacctggctgcctggagcgtcacccccacggttccttcctcatgcagcatcctctttgccgacatcgtgggctttacccagctgtcttctgcctgcagtgcccaggagcttgtgaagctgctcaacgagctctttgcccgctttgacaagctggcagctgtaagtccctggccccgcctggctctccagcggggcctgccctcatggcctctgcctggcccccatccccggccccatgattttctcccactgtccttcctctgctttcttggccactcctccctcactgaggaggggctggagcacaggccaggccctcccctttcagaaataccaccagctgcggattaagatcctgggcgactgctactactgcatctgcggcttgcccgactaccgggaggaccacgccgtctgctccatcctcatggggctggccatggtggaggccatctcgtaagtgggatgcctctgggagggaggctcccagagcaagggccccggccctggacccagggagaagcaggtcttccgcgctggccatggcccctgggtgggggatctgctggaagcagagactgggacacagcactggttgatgggtggcgcaggctcccgctctagaagctgggatgtggcttaccttcctcacagcccaggggacctgcgaggctcccccagcctgtggggcacacttttccagccttagtccacgtattctctttttgccagaagttgcagttgtgaattttctcacgcctcctcacacttgctgggacccccacaggggctccccatctctcctcagtgttttctcaccgtgacccccgaaggcactgccctctccatctcgtgatgcagtgactgtaagaccctggcagaggggctcagggatgaggctggatcccaccccggcctctgtgctccagccttaggctgtgagggaggcaaactctcctgccctcactgtcccctactcttgcccctgctccaagtgggcttgcagctctcggatgggcagtccctctggttgacttccagcctctgcgggacccggggtgacatcaggcaccaacacggaaagggaagctcctgccgaggcccctcccccatgggatggagtccaggaagttgcctgctctttacccccttctccgagggggcggctttgcatttttaccatcttccaggttaaagcccgtctagtattgccctggaaagaaagcagtgtggcctttaccccaggggtggtagtccaggaactctaacattctctccctgccctgtcagacacgttcaggcagggggctgttcacggctattttcttcacctctgtgtctgcagcaccttgaacgtgcctggcacatacttgatgctcagtgaaatattaactgcacgaatgaataaaagagtaattggcagagagaaactgaggcccctcgggaagtggggatagggaggaaagtcgcttggtgccctcgtcctgctggcctgtgatgcctgactctgggctggccctggcctgccttaccccccacccaacaccaagctgtggggaccttgccaggccccctcttgtggaggggaagaggcccacaatgaatttctcctgcaggagcaggggcagctggctgcctcgtgaaggccacaccctgaccctcctttctgtgtgtacctggcaggtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggtgagtgccattccaagggggcaggtttgaggactggggaggggaccgtcccctccatcccccagggctgtgaccctgatgagggacagggggcctcagagaaggcctccctacaaccccggaacagcattcctcctgtctcgccctggtcctggccctggctaaggccgttctgacctgccttggggtgaggcctctttgggcctgatattggatgtggcttttccttcctggaccctgcagtagcctgtcctcctgtcccctttaccgacttagggggctgcctcccctttacccactaagggggctgccccagctctccttatgtcagagcccaggtctccccaaagggagagtaatgagcagtcatcagctagcgggctcgcaggcagcgttttgcaggtcgcagtgcgattacacgccttacttgagctcccttacaggataatggaggccctgcctttagcagggcgaggctgagggaggatcagcccagccttccccatctgggccagggagcttccttcagtggcatttaggattcttggcctcagtggtgactcctcagaaacaggttttattatctcttggcagcaggggttgcaactgagaaacgtgcaaggtgggggataattggatcttgtggctcacgcctgtaatcccagcactttgggaggccgaggtgggtagatcacctgaggtcaagagtttgagaccagcctgaccaacatgacgaaaccccatctctactaaaaatacagaattagtcgggtgtggtggtgtgcacctgtaattccagctactctggaggctgaggcaggagaattgcttgaacccgggaggcagaggttgcactgagccaagatcaagccactgcactccatcctgggcgacagaacaagactctgtctcaaaaaaaaaaaaaaaaaaattccttatcgcatttgatctgctttacagcggatcaaagattgaagaaagattgtactcctgtgtcgtggctccaacactgaggctgagatgggagtaagtgccatacggcccacacagctagttagcggcccacacagctagttagcggcccacacagctagttagtggcagaactgcctccacttggcctctgccccacatgcccgagagacacggggccgagcagcagccggtgcagccgtggtccgtggactgtcccctgggggtgtgagggccacctctggccgacgctcagggcctctctctctgcaatccaggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggtgagttccccaccccaccccacccaccccacccaccccacccctggattagggggttggaaaggaggagattaaggaaagattgcagaagaggtggcaggacccagcagtggctggctgtgagaggtgagtggcaggctggcacccttcccaagggagagctggtttctgggggagatggtgagtgtaattcatggcaggttgcaatggaggtgactgaagcatatcccaagaccacatccaggagggggccgctggagatgtgtcggtggcgcccaggagagcagctgggttggggctcagggtctcctgcatggaggaagtgagtgaagccacaggagtgacgtggatgctcagggagaggctcagagaggagggtgggggtggggtgactggtcatgggggaggaggaccaaggccaggaaggtttcctgagtgggaaatgagggaggaatgagatagaagtaatagagcaggggtgtctaatctttcggcttccctgggccacattggaagaagaagaattgtctcgggccaaacaaaaaatactgtgggttgaacaagcttgcaatcgtgcatcctgtgggcctgccctctggtctttttgtgggatcccccgaatatctacagacctgaagcactcagcagcttccccaggtctgtccaccaacccccaaacacctcctgtcagtctgattagaaaccaccagcagctgttgcagaaatggatccctttaccatcccctgctgaatctggaggttgtcttattttttgtaatctcatgtcaaaaccctttcctccagttatgagagtccatctaacaagacttggaattaaggagcttggtgactgtcagggaagtcgtgtcatttgagactgctctatggctgaggctttgcctaattatggctaaagcaaagcccactctggtgaggctgccggagtgaaggctgatactccccgctgattctaacctcgatgtcagtctcatccagtgtcattttaaaggctgtctctgacaactcccaaatttgtatctccacccccagtgtcttccctgcactcaacatacagccacttgtacgtctccatttgtacatataataggtatcttaaatgccacctgcccaaagctcctgccctccttcccactccataacctgctctccctcggtcttcccatctcagttaatggcagttccatccttttattaacaactgctcagaccaaaaagtttgaaatcatccttgacgcctcactttgcaatccacaagcaagttctgtggcctcagattgctctctaatcccaccgcctcccacgcccttgtcacttccagacctgtccacgccactctcatcccatgcccagatcatggctgagctctcctttcctctaggccctgcccaatggagcaccagcttcctcaaagtccagctcccctgccctcattgagaccaaggagcccaacgggagtgcccacagcagtgggtccacgtcggagaagcccgaggagcaggatgcccaggtatgtgcagggctcagggcagggggtcactgagggccagatgcgggcaggcaccaggaagcaatacgttcctgcagcaggagtcctgtgctggggagacctggccaccacccaggacctgctcctgcttagcactgtaaccatggacaggtcacccctccagccccgcaaaaccccactgtctcctcatcagttacatgccggggtgagtaaggtcaaaagaggtgcttagctcggaggcctttgtagctctgatggcccggaatcctgtagatttgagatcagtgaggacatccatggaaaattatataggatctgagaccattttggaagtgagatatcagacctggactcacccctctggctaggttcaagccccacaagttccatgcaagatgggatatttccttagcccccaaaggcgaggaattagcatgctgtcccagagtgcagggtgcctcttggggagcacccagaactggtccctgaccgcagggcgtctggagcacgttcactgatggaggtcagtgctgcagagatgggatgtctgccctgctcgggctcaccgcgtgagggggacaggagagctggccctggtgccattagagcagatgccgtagaacaagagggtagatggggctcagggtaaattaggtttttcttgagtcccccaacattcagtaacttttccttgttgcagttttcttgatagaaagtgggggtccagactcagggcactcactagcaaggaggacacagatgcagctttagcagcctgatttttcgggccctgaccctcagccagggccacgctgctcccggatctgcttcaggaacaggttcccgctgctgccacagaccatccacgtgattttacagaaggggaagatgtggctggggaaacattatctggggtcaaactgtcaaccagtggcacacctgtgcctgtgcttaagaccagggagtcttttttttttttttttgagatggagtcacgctgtcacccaggctggagtgcagtggcgcgatcttggctcactgcaacctctgcctcccgggtgcaagagattctcctgcctcagcctcccaagtagctgtgattacaggcgtgtaccaccatgcctggctaatttttgtatttttagtaaagatggagtttcactatgttggccagtctggtctcaaactcctgacctcaagtgatccacccacctcagcctcccagagtgctgggatgacaggcgtgagtcaccgtgcccggccccagggagtcgtgactgtggctcccagatgcactgttgaacccgttcagacagctctcagcccgtctcagtgactattcagactgatggctgtgtcatcacagccaggattcctgtttttggagttgatgctttttctttggaactgggaataaaagggtagtgggtgccccagctccacctacccgccccttgtcagccctctagtgatgaggacattcttctctctcccatcactttccccctcagatcttcctttccaaatgagccagatgtgagttcctttaacagttccctgaagccctagagttgggagccattcatgtccccaggctgccaatgtatatggcccccacatcaatacagcaggaagtgccaggactgcctcagcccagcagctgtctccgattacaggtctcctgctcaggagccaggggctgctccctacaatgctgtcattagcggaccctccctgcagagctctgggtggggggcccggggagccaggaaagactggagctttgggtgtagatccaggccacatggagccacgtgggagcatggggaagacttcccggaaagggattttagagctggagggattggtcctccgagtatgccctcttttgttcctttcctcctccacctctgtctttcccagctcttccccaccactctgtcccatctgccccactcacgctgcctccctggctcacaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtgtaagcgccacccggaagcgtccaggcccaccactcctcccgggccctgacaagggattcaggaaactgagcatcccaaatacggcccccctgctaggccaaggcagatgtggcatttgggattcatggggcttgttcccactgcagagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggtgagggaggggccggggagggccacgagtttcctcggctgcggtggtgccgggcggggggcgggggcaggtgtctcagcgggagcctgacattggggagcaagccagtctctgctccctgacccccactgggacggcccccacaggccccaggagtgctagacggcaccctgggcatccttccttttccctgccccgcgttttggagcagtcctagcgtcagaatggggatctggccaggatcaagagagctgagggacagaggcctccagaaggctggagaccttggctagatgggcccacactgattcttgggacaaagatggggacactgcgtcagtctcagtcaccaaggctgacctggcccctctcttggctcatcttggtaaagatagattttaggctgtgggcacagactgacgccctctctaacgcagcagtaggtcctccagggcaaggtgtggcctcctggagtccccagctggtgaagccctgtctgagggtgacgaccactctcttgttctccctttctcccctcggccaatcggggattccccgtcacagaggaggggtctggaaccctgctgggattacagtttgtcaggagccttgggctgggtcacactatctaaggttgcgggtgtgtgaccacgtgcaggccactgcaggctccggcagcatctgtttcctcatctgtgaaatgaggagaacaacccctgccctagcggacactcacgactgtggtgaggctcaaattcactcattccataagtattgattggttgtctgcttcatgcgtggggatcaagggctggggctatggcagcgatgcggcacacagaaacccctgctctcgtgaaacttgggttctggtaggggaagctacaggcaaaagcaattaaacaattaaaatatgcatccatgcgagagtaagtactgcagacacagggaaggcaaggaagggaggcgggtatgctgctggggagctttgttttgttttgtttgcattttgatgtgggatggtcagagcaggacttgctggcaggataatatttcagtaacgcctggaagcgggtgaggggcgagccttctcctatctgggggacacctgcttcggatagaggtgctgaggctggagtggcctggcccctggaggcacagtgaggaggcatcgcattgggaacgggccacaggaagagtagcaggagtccagcacagacgtggggcctcctacacgccactgcagggtgccagcttccactcttaacacaggaggccgccagaacaagggagcagaggagtcccctgttgtgacatatgcctggagaggctcactcctgctgagaacagcgcttagtgagcacagcgggagcagtgagaccaaatagcggcccagacaagccactgtggtggccaggccaggccgaggatagaggaggatcagtggttggattccgtcgatagatgctgaatgtattttggagacagagctgacaggatttgctggcagattggttgtggggcgtgagtgtggagttgaggatgtctcctgggcttctgatctgagcaactggcaggacgggggtgccgttaaccaagatggggacaaggtggaaagatgagagtggagaggcaaagatcaggagtttgctttgggacacgtgaagtttgcagtgcccacaagccaaggaggccagcatccatgatctggagtttggagggcgggtggggttggagacgtgaacctggcatcaccagcatgcaggctgtgctgcaacacgagacttgctgagctcaaggcagcgtgtccagatgcagagacagaaaaggactcaagaaaccaagcgagaaaagtgtctcaaggaggggtgagaggtgactgaaaatgggacatggatttagctaccaggaggcttctggggctcttggcaaggacaccttccagggaggggttaaacgggaatgggtgtgagcagagggtatagagaacaggtttccgggagttgtcaggttaaggtggatgtgttgagtgtgtccactgtgaagctgggggtggctgtcacaggcagactcttagcccccggcagcgagggagtgatgctgctccgtgctctgtcctttcagcacagcgacatggcaggggtgcattcctaagatccctgcccaagtttatcctgggctgtgcccaggccacctgtgagttgttccctctctgggaaatgtcccaggcagcagctgcagctggagagtggcccgctcccaggccggcactcagctggcggcccgtctcatcagggcctttgtcctgttctgcacggcaggcagcagcaattccctggcaccgcgtggagctgtacaggctcgtgctgtgctgagaggcctccccgtcccctgcccccggctcctgtcccctgccccctgcccccttcccccggtccttgtctgctggcccctgcccccggtccctgtctgctggcccctgcccccgcccctgcccccagtccctgtccgctgccccctgcccctgcccctgtctgctgtcccctggccactgtccgctgtcccctggcccctgtccgctgtcccctgccccctggcccctgtccactgtcccctgccccctgtccgctgtcccctggcccctgcccccatccccgtcccttcctctcctagcccctcaccccatctcactgtcccctctggcctctcccaattgtcttctctctgtcacaggctaatgacaaactatgtgaccttcatggtgggggagattctgctcctcatcctgaccatctgctccctggctgccatctttccccgggtaagaggcacttttctactgagctcagaagcctctggaagtgagtggcactccctgtaaaactgggcagtgatggagttattctttctgtcaaatctgacaggcagacactcctctgttaggacggtccaggcacttgcccatccattcattcaccatcagcagagcactccctctggctgggccaccaggctgtggcaggctgtggtgggccacggctgggccgtggtgggccttgttgggccgtggcgctgcagcacgtatgagtacggcagagtctgggtaaacaagaacctgggtagagaggaagtggagggccggctggaaggtgggttggccccgatggtgaaggcccttagaagccagactaaagggattaaaactttctcctgtaaggcactgaggtaccaagcagagttttttttttttttaatcagaatgacaaaggtaaagcagtgtttaggaacataaatctgacaggtggctcgccaggtcacttggagccaggataggcaggagtagctggccagagacgagcagccctgaaaactgttcctgccctggcctcacctcgtcaccacgtctgctgtggaaagggctgcgacctggaggctgtgctgttgaacaggcacatcgaggaggtccaacacagcgtcagaactcccacgccctcttctcagctctgccccttggtcagctgtcaggtgactcccaggcagagtccgttttgaggctcctgggactggaatacgggaccagcctgagttgctgtcagtcacgtcgcaggagaaaggactggcaaaggctcatggcccttgaaattctgttccttctaggcctttcctaagaagcttgtggccttctcaacttggattgaccggacccgctgggccaggaacacctgggccatgctcgccatcttcatcctggtgatggcaaatgtcgtggacatggtgagctcctgctgtccttgttgaagggacgcccctgttctcagtggagaagggcttctgtttgggtcacacaagcagtttctcagtccatccctccaccgtcatgtagctttggagtggctcttaggttcccaaacacatcatccccacctagtggaaggagtcttgtccctgtcatccagggagcctctgggatggacttgtttccttgaagctcctctcccagagtccgagagcacagttccatgtgcccaggcctgtgctaggtaccttatgtatgttgattcatttaatctgtgaaaaagtcctgagcagttgtaccagtatctgcagtttcatagggagaaactaactctcaaaaagggtaattggttgggcgcggtacgtcacgcctgtaatcccagcactttgggaggccaaggtgggcggatcacgaggtcaggagttcgaaaccagcctggccaacatggtgaaaccccatctgtactaaaaatacaaaaattagccaggcatggtggtgcacacctgtaatcccagctacttgggaggctgaagcaggagaatcgcttgaacccaggaggcggaggttgcagtgagccgagattgagccgctgcactccagcctaggcgacagcaagactccgtctcaaaaaaaaaaaaaaaaggtaattcacttgctctaggtcacacagccaggaagtgacagagtccagaatggaggcagttctaagtcccagtcctgtgtattcttcctccctgagggggcagccaaatgctttcttggggaaaagggacaggagttgggagcccagatctattggtttagaaccactgggcacgtattgagcactacatgcctggagctgtcatcagtgttctcttgtcagttgtcacggcctcctctaattgtggtagtaccatatacactatcttccttttttttcaaatataatgttattgttgtactttaacaattggagcacacggtgccgggcgcagtggctcacgcctgtaatcccagcactttgggaggccaaggcgggcggatcacgaggtcaggagatcgaaatcatcctggctaacacagttgaaaccccgtctctactaaaaatacaaaaaaattagccgggcgtggtggcaggcgcctgtagtcccagctactcaggaggctgaggcaggagaatggcgtgaacccgggaggtggagcttgcagtgagccgagattgtgcactgcactccagcctggcaacagagtgagactttgtctcaaaaaaaaaaaaaaaaaaaaaaaaaaaattggagcacacaaatacaaccaacatggagacttattctgccagtggtataagtgaaaaagctccagggctgcagctaatcagaagtccagtggggggccgggcgcggtggctcacacttgtaattccagcactttgggaggctgaggcaggcagatcacttgaggtcaggagtttgagaccagcctggccaagatggtgaaaccccgtctctactaaaaatacaaaaattagccagccacaatggcacgagcctgtaattccagctacttgggcagctgaggcaggagaatcgcttgaacctgggaggtggaggttgcagtgagccaagaatgcaccactgcacgccagtctgggcgacagagcgagactccatctcaaaaaaaaaaaagaaaaaaaagaataagtctactgggaatgaggagttaggggctccagagcctaccttggccaggggttgctggtgcccactacccagggaagagaagccccaggccccctgcatgtcacaacatgcctggaacctggcacccaggtgtggaggtcaccactgcatggggtcctggacactgtacaggacacctggagatgctgtcactcatggaggggtaaaaagctagggaggtgtaacaactgctcatgctagaatgacatggcgggaatcgcgcaagcaagacaaggttgccctgtgggtgaaagttacaaaaagggggggttgattccggttctggatgcgctttctcccggccgcatctgcccagtagcagaaccagtaaagaatccagaaggcagtgaacatccccccaatggaaggatttgggcagagactagctgtcatcacggggaggctgtgagtggggctcatggtcccgtggcccctcctgaagcaacagtgtgatatggggaagaacatgttggatttgaagcctaaagacttggctcctacttttggcttttctgcttgctaattgtgtttgggcaaatctggcccgagttttctgtacaatagggacagtactaaaaatactcgagagagtttttgtgaatgtcaaatgaggcaacggcgaggctcttagctgcagttactaactttcatatgattagtccctggtaaatttccccatctttcccggtatttctgggggagccgcgggaggtggcagctgagcgtgcactaccatgcacagccctctgtgaccagcacctgctgttctcttgaacgtgtgtccctgcccgccgtcctggcctccagctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgagtaagatgaagcgtgactggggatctgtattgtctccttcctcccgcccgcaaagtcctcagttcaagctcatgggcctgtgctgaggtggctttctgccactaggggtcctcaaaggcttgttcaagaaccagttcctggctgctcacagacgtatcactgtttggctaggacctgagaatagattcttcccattctccccgagtggaggacttgggataccccggtgcctggctgggcatcaggctcttgttcccagatggggcctgactgtgctgttatctgtccaacagcttacctatggtggccttagagcagatgcaaggattcaaccctgggctcaatggcactgacaggtaagggccacggcttcccctcctggcctgcactcacagcccttcttctagagacaggaatataacaggcccaagccccgggatctcaccctcccgggaggcacgtgacctgatacgtgcaggttagagaagctggcatgggttcctccaggagggctgcagcagtgcagtgaggagggaaggaaataccaggtggatggcagctgcatgtaactggctggcaggacagacaggcagcaggaaaatgaggagggaggaagacgctttggatttggacctggcttctgagcctgcagcaggcagtaattctctgtgggtcacaggcaggtccgtttccatgagttgcaatttcatctcttgaggaggatactgaaccagaagttctctaaggtccctgccagtgccaaggttttaaaattttatgattccatgacttgaacagaccttcaaggaagtttagaaataaaaagatgacctaatagaagaggggtaaaacctgcatagcccttagcaaaagaagaactctaaatggccactaataaatggcactcaagtaatcaaggaaatgccagttacaccctagtgagataccatcacacacgtaccggtccagataactctgacaatatcaagtacaatagtaactcttacactcctggtgggagtatgagttagtacaaccgtgttagaaaatattttgatctatttagtaaggttgaaaataaacctgtgtcccagcaattccactcctacatacacacccacgcagacgtgtgtatatgtgtatatatatatatacacacatcttagagaaattcatgcacatactcatgtcccaggatatatgtatgagaatgtccaaagtggcactgttcgtaatagacataccccctcccccaaaacaaatgaaaacaacccaaatgacatcaacaggaaatggatacataactggtatattcatgcagtgaaataccatacggtaatggaaactaaccacagctccacataaaaatatgtatgaacaaggtaaaaagccatggtgagattgtaccccagtcccatggctatgaaatcccatcactgatgtctcttgcttctccaaattcctgcatggttgtagctacctctgtgatcagtcaggcaatgcagtgtttcttaaatacctggggagcagccctgatgtgaataccaggtgcagccaggaggggccaggggttgcctggctgttggagaggagcccagtgagttaagaaaattttactgcccgggggagcccgacttgatgtgaaagggcctaaggagccggggtgagctctagggctggggtggcaggaagcagcaccatctagttggagggaatcaggccccctccaggaggcagatgacagccctttcagttgcacacgctctgcccagcaggctgcccctggtgccttccaagtactctatgacggtgatggtgttcctcatgatgctcagcttctactacttctcccgccacgtgagtgccgcctgcacgatccccgctctgtgcccacagcccacagcgctcctgagaagcagccctgggacctaagagcccaagctcctaaggaatggggcttcccttcacccagccccacacgtgagcctggtcaggccaccgccttctctattcaggctccttcctcagtcacacaggaagacagttcctcacctcttccgtccgaccccctccaggatggtgaaggaagcatgggagtgaaggtgggaggggatagagtgaaggcacaaacatcttgaatcaaatcaatatcccctaggccaggggctcatggcccccgcactccccgtggcgctgagggacattaacacaactgaccacagagccagaagagaaagagaagggagctgatggactttctgttgggttaaaaggaaaagagaaggccggtgcagtggctcattttgggaggctgagggtggaggatcacttgagtccaggagtctgagaccagcctgggcaatatggtgaaaccctgtctctactaaaaaatacaaaaattagccaggcatggtggcccgcacctgtaatcccagctacttgagaggctgaggcaggaggattgcttgaatctaggaggttgaggctgtagtaagctgagatcacaccactgcactccagcctgggtgacaaagtgagacaccccccccgcaccccccccccccccgccacaaccaccgcactcaaccggacaaaaaaggaaaagagaaggaagagagggaagagaaagatcctctgtacttagggcccaatgttagttcaagtgccccctactggctttccagggaagtacagccttcccaagccacttcttacccaaatggcgcctgctagaaagggggactccaccctgagttgggagatccccactgctgccacctccacgagacagacctgcagctgaaattaggtcccaagaggccccctacacacggaaggcctcctggatctctgctgtaattacggaggctgggaaccgcaccactattgggtggccttttgatgaggtgcaatctttgcagggtcttacttcccttgccatttagccatcttccttccagcctttccaaggggagttcctccattcacgttcctgtttttcttctttttttgagactgagtctcactcttttgcccaggctggagtgcagtggtgcgatctcggctcactgcaacctctgcctcctgggttcaagttgattctcctgcctcagcctcccgagtagctgggattacaggtgcccgccaccatgcccggctaatttttgtatttttagtagagacagggtttcaccatgttggtcaggctggtctcgaactcctgacctcaggtgatccgcctgcctcggcctcccaaagtgctgggattacaggcatgaaccgccacgcctggccattcctgtttttcatccttctatccagtggccagcttagagcacatgcctcgccttgtctgtgtctgtaggtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggtgaggggtgtggtctcagcccggaaccatgaggccatttgtctccatctgttctttctttcaggcagcccccgctgggcccaggccttctcagggacaggggactggggcctaggtagggctgaacctaaacagcaaacacaaataagcaaaagaggaatttctccggcctcttataaagtgcactgctgtaggcatcgtgatgtgggccgtacagctctgaggccatgtgtcagaagacaagactttggctagagcccacctttctgttgcctgtgaacttctccaaacagagtggttcccagctctacggtaccctcgtcttcacagctggggctgttagaggaactagagaagctgttttaaaatttattcaaagtagtggccgggcacagtggctcatgcctgtaatcccggcactttgggaggccgaggcgggtggatcatctgaggtcaggagtttgagaccagcctgggcaacaaatagtgaaaccctgtctctactaaaaaatacaaaaattaactggacgcggtggtgcacacctgtcgtcccagctactcgggaaactgagacaggagactcacttgaacccgggaggtggaggttgcagtgagctgagattgtgccactcaactccagcctgggtgacacagcaagactccatctctcaaaaaaaaaaaaaaaaagtagcgatgagctatttttaaattattcagagttggaataatctacagccgggcatggtgacatgtgtctgtggtcccagatacctggtgttcaaggccgcagtgtgcttcgatcatacctaattgtgcttgtttactgccactgcactccagcctgggaaacacagcaagacccactcttaaaaaaaaaaaaaaaaatgctggaataatctgactgatgtgtgagtccaaaaagctgagtgcacatgtcatgcatggaagatagatgcatttctccaacacatcatccagtcagtcggacatgctttgagcacgttgtccgcacctctttttaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctgtgagtgcccatcccaccctgcactctggccatgaagccggcccattccacatcacatcctacaataggctgcagaggccagagaaactggcttcattttcccagataagccccttccgcaatacatggacttctgcagccacctggaactgctgggctggggaaggggaggtgaggtgggagcccgggaaatcacccacagggtcacaggataaggataaggactggccaagcaacatctcgagacctctctgtcctgggactgtctcctcaaattcagagccggtcagcattgactgggtgacctgtataccagggagaatgcttttacacacgcgcggagcccccctaggagactgccgattttatgtcagtgttgaggttgtggaaacaggcccagaaagttaggaagttctcccaggatcatgtggcagataagcggtagactaagtaacaactttgataggaaagtgtctcttgggtttagtggggtccttgtaaacaggtacatctgtcactgggttgggtcattcctctcccttgactgctgacaattctttcctgaatcctggcctcagctcctggacaatcccaagttccgggtgatcaccaagatcaaaaccattggcagcacgtatatggcggcttcaggagtcacccccgatgtcaacaccaatggctttgccagctccaacaaggtagctaaccccagtagccagagagatgaggctctgcccccaaggcaagagattggcagcccagacctagcatgggggaaataagaactgctgtgcaaagtggtcccagacacacaccaccagcaccacgtaaatataaataagaaatagggtttattgagaaagttcggcaagcagagaaacagaacagacacacaaccccctgctgttcacagctcaggcctaagatggttgtgttctgtggccaggccccctaaggctctgtgctttcataggaactggagagcaattgtcaacaagggaaactgaaagcatggccttcagaactctggctgacggcagcctgttcttttgttaagctaatttagacctttgttcagctaccaggagagaaaattaggtgtaggagccctggtcccaagctctggtcttaaaacaccatcatcctgctttacctctacaaccatcccacggccctattatatggatgaggttaaagaaacacgtccaaggcgggtcatccccctccagtgcttatcacctagttgagggatccaaacaaggacaacctgacaaaacctaaggaccaggaccaggcccagccaaggtgaaggggtccgcctcgtggtcagactcacaggtccgtctcctctgctcaattgcccagtctttgcctagacctgctacgtgaactttgtcacagtggcaagtcagagctagcgtggctgcgactcctttgtgggaggaaaagtaaggccttgaacatctaggtgtagggaatccacccccagaacactgccagggaaggcagcagagcaggctgctgcagtgagcggcccctgacactttctccacggtcccctggcacaggaagacaagtccgagagagagcgctggcagcacctggctgacctggccgacttcgcgctggccatgaaggatacgctcaccaacatcaacaaccagtccttcaataacttcatgctgcgcataggtgagcacccccagctggcctgccccgcagcaggctcccttcccatgcaggggcctggcccaccaccaggagagacatgaggctcaggacaactgaggcaattcgggtggggaggttcacgcactcacagggcaaggagacctgaaagacctttagtccagacgactctagatgactaaaccaaaaacccagctgatgtgatgatccgactatactgtgcctactgttacaatagaagcttggcctgcctggctgagaagtgagtttgtgatccatttccagaggggttgctgtgcctgctgaggacatggcttcccagacaggcctgctctttgaaaggagttaagatcacctgctgcttctactgagggggtatcattcctgagtgaggtcccaggagacttgaaataccagctgtgttagaagctggccactaccatgccgagtaaatctgcatatggggggggggtggcggctgacacctaacaagcacacggataaacaggagatgtgatttccaccctccaatagcatacagccaagttgaatgaggacaatgatgtgttacattaggagctttgtggtacaggtctggagaggagatggcttctgaggcccataacaaggtgtggcctgtggctgtgctgaactttatgcctctaccctaggcatgaacaaaggcggggttctggctggggtcatcggagcccggaaaccacactacgacatctggggcaatacagtcaatgtagccagcaggatggagtccacgggggtcatgggcaacattcaggtatgtccagtggcacagctggcacgtgctcagactcggcatgagaacaaaaccggaacagtgctttcccacgtgcccctgcctcccaccctggccctgaacagtaagtccagaggcagagacgtggggcaagtggaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatggccatcctaggagagaagtctctggatgagaggaggcccccagccagtcactccagggttctccttcccacccgctgctcgccacgggtggaagggcttggccctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagccagacacaggttttcatatctgtgagtgacccacacgccaaggaaccagaggtgccagcaggtcagaggcccgtggttacggcaaatcaggacactaaccggagagcctgcaggagagggaagacccggggggcgcctgagtccccctgagttaatgggcagatttctaactaactaactgtgctttttcagaggggacttcctagtacattcacagctctactaaacttttaggaaacaaaatatgagacacactgaactctgattattttatcctactgctttctcacaccatatttataaagcagtggcctagaatacactgcgcctaaccaaacaaacactgaagaacttccttttcaaaagtttcaaacaggaaaatgaggaaaaattacttaaagctttcataaaagctaaaaatactttccttttaaaaaaaaaaaaatattgggtcttccttattatcttcattagtgaatgtgggttatttttccatttatttagatcagtgtttctcaacagaatcaagctattgcagtttgagtggagtgctacatttctgtgagagccctttctgaaaattttaggatttttggcatctctattcctggcattaaattagtagcagttactgtgacaacttaattgcctggtctttcccagagttaatgccctcaataatttgatatttttccataagtacttcttgagtgatacacctttttcaaaaaatggcttttattgccccacaaatgattttcaactaaaatgtatgatcaactaatacctttaaaaaacatcttgagcattttaagaagggaccaggtgatcatgggaattgttcaaaaatgccagtgtctatactcaaacctgctcttccatccagatgaacaggtaggtgtctgttttcatcagaagggtgatgtacccttcatcagacagtactacccacctggtactgtcttcagtactggttacttacctctgatgtgctcccagtgcagtgaaaacaatctattaggagaccagactcatatccaacttttctccttttcttgtaaatgaggcaaacacttgatgcaagggcttcgtacagaacagagtttcatgagatgctcgttgctcctcccatgaagtggataatacttccactcctaaaaagaaagattccatcaatctcattcagtgcagctgggggaatcggagcctggatcactgatattcaatctcattcagtgcagctgggggaatcggagcctggatcactgacattcaatctcactcagtgcagctgggggaatcggaacctggatcactgatattctggacccactggacccatacagcttttttttttggtctggactaaggctgccccttactggaccaatgcaatctagagactggggactggaatctaactgcgcagagaaatcaaagaccgatggtgtgaaatctggggcagcttcaaaatttctgcctcctaaaaacatttcacccaatttttcattattgcccatgtcacatttaactgaaacaggttcaccaaaaaatctctctctcagccagtctggaaggatttccatttagagactgctccgtagggaggagtaagtgtgtgctgacgtgtcatgtccatttgtcttcacagtgaaatgagtcttctggctccatccaccataactgacccatgactcagccttatcattaggtgtctttcctgaagcagggcccccagtgaaaacaaatcataggctgcgagaacactgctgaggtgggtgggcaaaggagaagggaaaatggggacaatcatgtttaccatttacaaagaggaaggaaaagactggtagaaacaagaatgttctatcttaccggtctgagtaatgtacagtatataaacagagaaagtgtctcaagaggtctacttcatggattctacctattttccctgtttcactcaaataaactgggatatgagaatttctgcactgaggcacccttcttaccttgacatgtcacggtgacgtcagtgggaagagttgctgtgaggtccttatacagcaatctagcacagaacgggaaggactgaccccctggatccagtttgtaagtaaatgacagcaagttacacagtgggtttctctgcaagggcccagtcaggagggctgcaaagtcactctaagaggggtgaggaacaaaacgaagtagaggatgactgcagttccaaaggtggtgtttactgacccttcaattacgtcaaccaaaaagaggcccatcgattacatttcagagaaataaatgagggacagaaaaaggtctgaaaaaaggactaatgaaaaagatgcctaagataactaagagtcactggcagcctggaaaggcctataggcctaaatggccaggggtacagcttcgcaagagactgtttctgcagaaacttcactgacgttacacggctaagatgcttcatgactgcatccacatttcaatttaagttaaatctacagctgagagcttcagagttactccaaatccatagagggggaaatgctaagcttgtaggaggcacttacagcctatttgcattaatttcctatctacttttttcacccaaccttagctcaactgcaacccaaaaaggtaggctagagtttaggggaagatggacagcattgttccatggcactgcagaaacctttcttctctaatgagatctatacccaaggttcagcaaggcactcggtatggtacatagtaggcacgccataaatccctgatggatcaaaagtatagcaactgcactctgtacaatcttacgataaaagcttgaagaccaccattcaggggtgcataatcctttaaccagtacccaggcttcaacgccatccagagtttcaaaagaaaagagggtgggatagtgcttttatataaataagaaacaagcatcggaaaggtaacggtcaaacttctaactcacagttaggaaacactgaaaatacaaaaaacatcccccttttaagttgatcttgggcccacggatgaggcatataacatcccagagagatacctgaagccggtctgcctggtacttcctcccagagtaagcattcaggtactcgcagagactgaacaggaagtgctggatgttggtctgtaaatattttgcagctatctcttccaggggaatgaagactgggactgaatggtgatgtatccggagtggtttctgtatgacaaggtccacaaaataggaatccaataggttcccctcaaaagcagtactgatgcagacacaaactcctcggctggtcagtttaccactgaggcctgaggcaaacaagaagacacctcaatagacagcaggccaaggtgatgtcttactcatctgtgcctccagtagcttccacagtgcctagaatatgtacactttgtacacaaatgtttgttcaatgagtatcataggctcattcttccccttggctccggctcactttgagactgagttgttaaaaccatggaagaatggtaaaaatgaaaaaacaacctaaatgtcaaactattgagaaatttttttttttttttttttgagatagggtttcactctgtcacccaggctggagtgcggtggcacgatctcagctcactgcaacctcaacttcctgggcttaaatgatcctcccatctcagcctcccaaacagctgggaccacaagcgcatgccacctcacctggctcatttttaaatttttagtagagatgaggtcttgctatgttgcccaggctggtctcgaactcctggactcaagtaatcctgcctcagcctcccaaagtgatgggattacaggcataagcaaggccaaaaatttaatttatagctattctttatttctgagtgtgaagtaatttgtcagagtccccagttcttcccacaactatcttgtggcatagatgggagaataaatccctatttacggtgaaacggagacttggaaagttcaaactatttcactagtggcagaaaacaagccagcagtaaagacagttctagtacaaggtctggcacatgacgaactgttaagatgagtggaataagccagccaccaactgagctgctgtacaaaggggccagtcaatcttgtaggtgaagataggcctacaaatagcacgtcagctgtgtgtgtgtctgtgtgtgtgtgtgtgtgtgagtgatgagggcagagggtgtaaaatactataaattatgaaataattccaggactgataacacatctagcaaactaactcactagaggcagacccagactaaattaggttaaaaaaacaaacaaaacctgtaaaatgatatgcctgcagaatggctttcacattttccaatttctcttccaatgcttcttgctcattgatctcc

SEQ ID NO: 6237 - DNA, 545 bp, Homo sapiens
gggctccaaggcttacgctgctagctatggcccagcagaaggtaccaggctgacccgccctctgagaacaactatgcaagctggataaaataccaaaaagaaacaagcaagcaaagagagcaaatggtttgaaggcattccagaaggatccaaatagccaggattggagagtactgacaaatgctctgagctggcttccctgcagcctctggcctcagagcatttccttattcatatgcaaggcacactgggccacatagaaaggcataaactagactccgcagcagtctcatccggaacaaacactggacattaatggtatcaaagcagactttctacgggccaagattccatagaaacaggaactcaacgttctgcttgcaatcttccctcccggcatttgctaattcctaagctgcacaggtgtgactggggactgagaaaccaaacggaaagaagctgctaaaggggaaaaagccaagcagagattttgctagaacaaaatgtggatttcagggcctgccagggaacaggagccttaatag

SEQ ID NO: 6238 - DNA, 780 bp, Homo sapiens
ctttcaagacaatggatgtggatatggccgaggaacatgccagggcccagatgagggctagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcacgagtggcaccaatggaggggccagcaccagcgtcctagatggccccagcaccagctccaccatccggaccagaaatgctgccagagctggcgccacgttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaat

SEQ ID NO: 6239 - DNA, 1262 bp, Homo sapiens
  misc_feature (395)..(395): n equals a,t,g, or c
gtacctggaatacaagaagatccccaacagcaacccacctgagtatgaattcctctggggcctgcgagccgccatgagaccagcaagatgagggtcctgagattcatcgcccaggtaagggagcgcctctgttgggtgcccggcacgggggtggtgctctccacaccttgcttgtttcttggtcgaggcctccttcccattaccccgtattccagtgagggtacaaacactcacagaggcacctgagcaccctacacaaggtcacagatggggcaaaatcccaggtctggcacaggagagtaggagccccaatccctgtggtcctgatttttgccatcattgcacaaagcacacgggagggggtgaggcgggcgcgggtgctcagccagtgtggngtagctctgtgtctatgcctgccctttttctcctcagaatcagaaccgagacccccgggaatggaaggctcatttcttggaggctgtggatgatgctttcaagacaatggatgtggatatggccgaggaacatgccagggcccagatgagggccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactgggcaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgca

SEQ ID NO: 6240 - DNA, 1568 bp, Homo sapiens
acagaggctagtagcacagagctgacttcacccagagtgatgggcaggcacctctgtggactggggcactcccctccagccaccagtcaccatcactgcagagactcatgcggtggcaaaggctgcttccccctccttcttactgacccccaccatccttcctttatgtgtctttaaaaaaatcccaacagcacacaatgcttcttattcctttttcttctctccatccctccatcactgccctagttcaagctcctccccttcctgcctgggctgttgcagggctttctctcccagtctttctgcttctggccctatctgtctccatccttgctacacacagctactgggaggatcattccaaaacacaaatctgagagagtcttcccttgccctcagcataaagactagactccagccaggcctaggaagccctgctcaagccagagtccacctacctgggccctctctcctatttcccattctgctactctgcttaacacacatggaatttatgccaaactacttggtgctctcaaaacatgccatggtgtcttttgcctctgtgtcttcacatattgtgtgtctctgcctgaaatgcttttccccgccttgataacctggtgaacttccagtcattccttgctgatgcagacagatgggtgagtgactgtacaccttcctctcccttgctaccttccatcagagaggctgggaagcaaaccgtccacttccccagcctcccttgcagtgaggggtgcccacatgagagacattgtctggcaccagcccttccccactgctttctgtcttgaacccagatgtgatgcctggtgcagctgcagccatctcatgaccatgtcgcaacaaacaccacacgacccaagtgacaagatgaacagtgcctggatgcctgatgacacggttcagctgccaggccaaccccaagcagccaacctctggaattctcaggagataattaaacattgataagactgaagacactgtgaatcaaattgcctgtcacttgcaactaaaagcactcctgattgacactgggcctcacctcaagcactcactactcactgaagtccttctggatccctgctcctagtacaccttgcacaagcccatctcagcacttgtcctgttcactatattagatttgctcattgtctccctcccccattatactgagaccttttagaggaaagagactgagtctttccactttaatctttagtacctagcccagcccctagcacacagcaagtcttcagtaggtagatttgtagaatataggtctattttccagccttatattgtaattttatacttacagtatttttattacaagctgcctccattccttattttaaaaaggcaagagaaacctagatgtccatcaataatggactggataaagaaaatgtattatggccgggtacagtggttcacatctgtaatactagcactttaggaagctgaggcaggaggattgtttgagcgcaggagttcaagacaagcctgggcagcacagtgagaacctatctctacaaaaaaaaaaa

SEQ ID NO: 6241 - DNA, 1569 bp, Homo sapiens
acagaggctagtagcacagagctgacttcacccagagtgatgggcaggcacctctgtggactggggcactcccctccagccaccagtcaccatcactgcagagactcatgcggtggcaaaggctgcttccccctccttcttactgacccccaccatccttcctttatgtgtctttaaaaaaatcccaacagcacacaatgcttcttattcctttttcttctctccatccctccatcactgccctagttcaagctcctccccttcctgcctgggctgttgcagggctttctctcccagtctttctgcttctggccctatctgtctccgtccttgctacacacagctactgggaggatcattccaaaacacaaatctgagagagtcttcccttgccctcaacataaagactagactccagccaggcctaggaagccctgctcaagccagagtccacctacctgggccctctctcctatttcccattctgctactctgcttaacacacatggaatttatgccaaactacttggtgctctcaaaacatgccatggtgtcttttgcctctgtgtcttcacatattgtgtgtctctgcctgaaatgcttttccccgccttgataacctggtgaacttccagtcattccttgctgatgcagacagatgggtgagtgactgtacaccttcctctcccttgctaccttccatcagagaggctgggaagcaaaccctctacttccccagcctcccttgcagtgaggggtgcccacatgagagacattgtctggcaccagcccttccccactgctttctgtcttgaacccagatgtgatgcctggtgcagctgcagccatctcatgaccatgtcacaacaaacaccacaccacccaagtgacaagatgaacagtgcctggatgcctgatgacatggttcagctgccaggccaaccccaagcagccaacctccggaattctcatgagataattaaacattgttaagactgaagacactgtgaatcaaattgcctgtcacttgcaactaaaagcactcctgattgacactgggcctcacctcaagcacccactactcactgaagtccttctggatccctgctcctagtacaccttgcacaagcccatctcagcacttgtcctgttcactatattagatttgctcattgtctccctcccccattatactgagaccttttagaggaaagagactgagtctttccactttaatctttagtacctagcccagcccctagcacacagcaagtctttagtaggtagatttgtagaatataggtctattttccagccttatattgtaattttatacttacagtatttttattacaagctgcctccattccttattttaaaaaggccaagagaaacctagatgtccatcaataatggactggataaagaaaatgtattatggccgggtacagtggttcacatctgtaatactagcactttaggaagctgaggcaggaggattgtttgagcgcaggagttcaagacaagcctgggcagcacagtgagaccctatctctaccaaaaaaaaaa

SEQ ID NO: 6242 - DNA, 1569 bp, Homo sapiens
  misc_feature (1558)..(1558): n equals a,t,g, or c
acagaggctagtagcacagagctgacttcacccagagtgatgggcaggcacctctgtggactggggcactcccctccagccaccagtcaccatcactgcagagactcatgcggtggcaaaggctgcttccccctccttcttactgacccccaccatccttcctttatgtgtctttaaaaaaatcccaacagcacacaatgcttcttattcctttttcttctctccatccctccatcactgccctagttcaagctcctccccttcctgcctgggctgttgcagggctttctctcccagtctttctgcttctggccctatctgtctccgtccttgctacacacagctactgggaggatcattccaaaacacaaatctgagagagtcttcccttgccctcaacataaagactagactccagccaggcctaggaagccctgctcaagccagagtccacctacctgggccctctctcctatttcccattctgctactctgcttaacacacatggaatttatgccaaactacttggtgctctcaaaacatgccatggtgtcttttgcctctgtgtcttcacatattgtgtgtctctgcctgaaatgcttttccccgccttgataacctggtgaacttccagtcattccttgctgatgcagacagatgggtgagtgactgtacaccttcctctcccttgctaccttccatcagagaggctgggaagcaaaccctctacttccccagcctcccttgcagtgaggggtgcccacatgagagacattgtctggcaccagcccttccccactgctttctgtcttgaacccagatgtgatgcctggtgcagctgcagccatctcatgaccatgtcacaacaaacaccacaccacccaagtgacaagatgaacagtgcctggatgcctgatgacatggttcagctgccaggccaaccccaagcagccaacctccggaattctcatgagataattaaacattgttaagactgaagacactgtgaatcaaattgcctgtcacttgcaactaaaagcactcctgattgacactgggcctcacctcaagcacccactactcactgaagtccttctggatccctgctcctagtacaccttgcacaagcccatctcagcacttgtcctgttcactatattagatttgctcattgtctccctcccccattatactgagaccttttagaggaaagagactgagtctttccactttaatctttagtacctagcccagcccctagcacacagcaagtctttagtaggtagatttgtagaatataggtctattttccagccttatattgtaattttatacttacagtatttttattacaagctgcctccattccttattttaaaaaggccaagagaaacctagatgtccatcaataatggactggataaagaaaatgtattatggccgggtacagtggttcacatctgtaatactagcactttaggaagctgaggcaggaggattgtttgagcgcaggagttcaagacaagcctgggcagcacagtgagaccctatctctancaaagaaaaaa

SEQ ID NO: 6243 - DNA, 438 bp, Homo sapiens
tttggccaggcatggtggctcacacctgtaatcctagcattttgggaggtcaaggtaggtggatcacttgaggtcaggagtccgaaaccagcttggccaacatggtgaaacccccatctctactaaaaatattttcaaaaattagccaactgtggtggcaggtgcctgtaatcccagctattctggaggctgaggcaagagaatcacttcaactcaggaggcagaggttgcagtgagcaccattgcactgtagcctaggcaacaagagtgaaactctgtctcaaaaacaaaaaaagtttttaaaattaaccaggtgtagtggcacatgcctgtggtcccaggtactcaggaggctgagatgggaggattgcttgagcacaggaggtcgaagctgcagtgagctgtgatcatgccactgcactccagcctgggcaatgg

SEQ ID NO: 6244 - DNA, 375 bp, Homo sapiens
tgaaggcaggggtcatgtttggcatctgtcaccctttgcgagttgcaacctggagaccctggagggtgttatgatgagtgaaataacctaatcacaaaaggactaatactccacaaattcacttatatgaggagtctaggagtcaaattcctagagactgaaagaacggtggttgtcaggggctggggagaatggggagttcatatttaatggggacagagtttcagttttgccagatgagaataacctggaaatggatggtgtgatgtttgcacaatgtgaacgtactttactccactatacatttgaaagtgagtgcaatggaaaagtttatgtgatgagttttttaccacaattaaaaatataacaaaataa

SEQ ID NO: 6245 - DNA, 438 bp, Homo sapiens
tttggccaggcatggtggctcacacctgtaatcctagcattttgggaggtcaaggtaggtggatcacttgaggtcaggagtccgaaaccagcctggccaacatggtgaaacccccatctctactaaaaatattttcaaaaattagccaactgtggtggcaggtgcctgtaatcccagctattctggaggctgaggcaagagaatcacttcaactcgggaggcagaggttgcagtgagcaccatcgcactgtagcctaggcaacaagagtgaaactctctctcaaaaacaaaaaaagtttttaaaattaaccaggtgtggtggcacatgcctgtggtcccaggtactcaggaggctgagatgggaggattgcttgagcacaggaggtcgaagctgcagtgagctatggtcatgccactgcactccagcctgggcaatgg

SEQ ID NO: 6246 - DNA, 375 bp, Homo sapiens
tgaaggcaggggtcatgtttggcgtctgtcaccctttgcgagttgcaacctggagaccctggaggatgttatgatgagtgaaataacctaatcacaaaaggactaatactccacaaattcacttatatgaggagtctaggagtcaaattcctagagactgaaagaacggtggttgtcaggggctggggagaatggggagttcatatttaatgggggcagagtttcagttttgccagacaagaataacctggaaatggatggtgtgatgtttgcacaatgtgaacgtactttactccactatacacttgaaagtgggtgcaatgggaaagtttatttgatgagttttttaccacaattaaaaatataacaaaataa

SEQ ID NO: 6247 - DNA, 24079 bp, Homo sapiens
ggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaaggtaaggagtgtgaggaatgcaagctttaagagaagtctatcatctattttattaactcttgcatgtgtctcacataggaatgatggggtagcttttggattgaatcaccatagtttagacgtttaatttattaagtccagaaactgaatagtcatagtaaattcgaggatgatcagttacctgatgatgtaggagacaaattaaaatcacatgggagttatgtataaattagaagtcagcttattacataatcagcaccatctttttcgagtgactggaatacttgtatctaccacctagacacccctcttctaattatcagtggctcccttggtaagcatggaattagaatagaaggagatggatggacatttggcggttttatcaggccatgatgaggccccatgatacatctctgttttcccagcgcaaaggaaacttctcaggggatcagaatactcatggtgactagatctggtatagccccatttcataccatgctgggtgcatgctaatgtttgcttttctgcactttgctcttttgagctcatgattctccttctgttggtatgtttccctctttacatgtgttaactctgttgttaccttgctgtgcatacacatgagggaatacatctccagagtcatgcctcttcccatttttagatttttattagatctcagagttattgaggcgctgatcccgctccgtttttttgtatgctaagctgatccttaaaaagtctttcaacatgagtttggaagctttgttttgttatctaaagactctgaggccaggtgcagtggctcatacctgtaacctcagcactttgggaggttgaggtggaaggattgcttacatccaggagtttgagaccagcctggacaacatagaccatgtctctgccaaaaaaattttaaaacgtaggtgcagtgctgtttgcctgtagttctagctgcttgaaaggctgaggtgagaggattgcttgagtccaggaggtcagcgtggcagtgagccatgattgtgccactgcacaccagcctgggtgtcggactgagacagtgtctcaaaaaaaaagactttggttacgtcagtggttctcaaagtgtggtctcagaaccggcagcatcggcattccttgggaacttgtttgaaatgcagattcttgggtcttccctcagacccctcaatcagaaactctgggagtgagaaccaacaatctatgtcttaacaagctctccagatggttctaatgtgtgctgaagtttgagaactatgagcttaggcacattgtgagtgcagatttccaggtttacactctatcagggtccgagttatacttccagagtcattctggcctatcccttaaggctgccaattgagttgcacttagttgtatttagctaataaaccagggaaataataaagtactcttaaaaatgtataggcagttcccactcctacctttttaaaatttttatttgccacgaatgaaagctcattgcatcattaatgtgagtgataacaacattaagatttgtaaatggtaatgtgctaaatttttgtttttcaaaaatgtttcctcctgatatatgttctgaaaatttggaaaatgcaaaatattataaagaagggaaatagcactcatctgtgcaacaaagataactgttaccattgtggccaatttactattaatcttttttcctcagattaaaaaaatgtataattggatcagtatatgtagttttttttctgttaacattaacaaggtaaacagtttttatgccattaaaaacttatatagctgtcattttaaaaacttcagtgtagaaaacttccaacatacacaaaaggagagataatagcatatgaatcttttatctaccatcatgtagcttcaaaaattatctactcatggacagtcttgtttcatttatacctctccccactactttgtttggaagcaaatccaaacatcatgaaatttcattcaaaaatatttcattatttatttttgaaaaaaaaaaaggattttaaatagatctacattagtgttacacccacagaagcacacccacaattctttaatattatcacatattcagacagtattcacatttcaccagttgcatcttaaatgtttttatatagttgatttgttcaaatcaggatctaaaatatgattcataccttgcaagtggttgctatatcttcagtctcttttaatctataggctccacctctctctctctctctctctctttttttaacttaactcccacctttttcgtttgccctgaaagaattttgacctttagaatttttcaatggattttgctgatggcatcaccatattttgttcctctgaatcttgtcaagtgaaaattaaatccaatttcattctgattggataggaagagggagtacaggattaacttcataggtggttttgtatatttctgtcaggaagctttttatgattttagttgatctttgcctacatttattatttcagtgaaagttttaaattatgataatataatcctgtcattcatttttcatgtatttgctggaatgtctcttcatcaacctattcaattaccctgaagtacattttgagtcggaaagacaggataaatgctttattcttttgcttttgtgtaccagttttcaaaatgatgagttggttcccaagcatccttcagaggaggccagtgagttttgttttgctttcagctttgttatgaacttatagatttaaacatattttatatgttttaatctattgcagttatttttttctcatggggactcagattatccatctttgccagtgagagcctcttccacaattggctccgaatctttttgagattattccactagtgtttgagtttgcctgctttctagttttattctaggctaatcatgtatatttcctgcccgtgactgagaacaatcacttttttgaaataacctggttcctttttgtgagaaattatatttagaaactacagacagatgctggggtgctcgctcttacttggttgatcattgtttctagataagcatcaattatagtgaccatgtaacttttcactttgttagtgatttgatgtttaaaatgccaagaatagtatcttttaaaatatgtcttgttcatgagcagattatttccttaagaagtactaggtcaggcccggcatggtggctcacgcctgtaatcccagcactttgggaggccaaggtgggcagatcatgaggtcaggagattgggaccatcctggctaacacggtgaaaccccgtctctactaaaaatacaaaaaattagccgggcgtggtggcaggtgcctgtagtcccagctactcgggaggctgaggcaggagaatggcgtgaacccgggaggcggagcttgcagtgagccaagatcgtgccactgcgctctagcctgggcaacagagtgagactccgtctcaaaaaaaaaaaaaaagaagtactaggtccaaggctataaacttaaataaggcttttaatacatattgccagattattttccacattactaatttgtactctcttgagaatagtgagaggatgcatctaactttacccccttattagcattaagtattcctttttcatttttgttaatttgatagattaaatgatttttattttctgttagtgacattaaaattttaatgatcttattgccatttgattttccagtttgaggtattgactgttcatattcttacctaaattatctgttgagattatggtatttttcctttttctggatactttatctagagatattattaatttatcttgttaagctttttctagtttatttgctttaaaattttgtttattatgcatttgaagttttaaaaagtttatcatgcacagaaattttaaaaagtttaaaaattagatctatccatacatttccttattgattacattgtttttcagcagaagtcttttccactaataaatgtgtacatttattttaccttccttctctgtttcctcctgttctttttctttctcctcctccttaacttttaattctcttatttatctagaataaagtgaggaacagactggatcagacttcatctcccattcccacacttagctaactagttgttccattattatttattaaataatctttctttttctcccactgacttaagatgttacctttgtcagattaacttcttatacgtgtatgatttttgtattatatttttgcatcaatctagactacatttttcttacttagtttaatatccactaaaaaaaatgggattttttttatttaaaaaaaattccccagctaatctcatctattttttcttctctacgaacttcagaatcattttaaagttccaaaacaggaagagaaattcacagggagatttttattgaaattacttaaagcctgtgtaaattaacttataaagaattacagtttttacacatttcagtccttcccttcatataattttataaagatttataatttccttcacaatagctctctcacagctttcatagtttgtccttttgtatttctttagacttttctaactatttattgctgatctataagaagaaaactattgattaaaaaaaatttcacatctagctattcagttattgaatatgagagttttaccttgtcatcttgacttttgtagatgtagcattatctgcaaaagaaaatttttacttatgctgacaccatttaaaatgtttacttttatgttagaacaaaaataattatatactaaaaatattttctatattaaatatataatacatgttatataaaatatattttatatgtttatgaaattataatctttaaaaaaataattttaccttttattgcagccatttcttcctttgtctgatagtggtgttatatatgattctgatgaaagcattcatagtgatgaagaagatgatgcctttttttcagatacacaaatacaggagcaccaagatccaaattcctataggtaaataagacttttctttctctcattttttttttggcttttctttttgtagaaaatatcaatgttattaattttaaataacattattatcctgaatttatataagaaatgacttatgtttccaggttacaaattctacacctttgaggtcaatgtctacatagtgttttctccacctccaaagactagcttttatggagagtgcaaacacaagcatctttagtgaggaaaaaatatgtaactcatggatatactattagagtttaatatataaattattggtatactattaggtttcatgtgactatgtggttaatctttttccacgaggtaattttcagcaagtgtaatatagtattgcaagttttttgtattcagtgaccacagaggtgccatttttgcatagtaaatttcaatgacagctttttttctgggttggagagtgggctaaacagttggcagggaacaccactctgtttctcccatgattttatttttcacttaaagactctttttgcccctccttgaacagctgggctcttctacatttgacaatggttaaactagcacttcacaatgtcaagaatttctttcctattgctggactggaattctctggtgagtttggaatttaaaaattaatgttattaagtataataaattgccgtcaagtttctctttacaaaatctatatataaggtcatttggtacttaaaaaatagtgcattagatattttataaagtcttgtttattttaggctccaatctgtgactttatttttatttttttagatagagtctcgctctgttgcccagactgtagtgcagtggtgtgatcagagctcactgcaaactccgcctcgtaggctcaagccatcctcccacctcagtctcctgagtagctgggactatagatgtgctaccatgctgggctaatttttgtattttttgtaagagacaaagttacatcatgttacccaggctggtcttgaactcctgggctcaaacgatccacctgccttggcctcctaaagtgctgagattacaagtgtgagccaccacacctggcttcagtctaatactttagtttatatcaagaatcactctctacacagaagattgagaaagagcagaaacccacttctgttttgttgaaagcattaagaatctaaactgtattacattaacatttgcagatttatttgtattttcagaagtattatctctgagaattcagattctataaatatttgggtgatgatcgatattttttattaaaataaataacatattctgtcaccttgtagagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtaagaaagctcttataatgctgataaagagcgtagcttaacttttctggaagacagtttggctaaatatgccaatatactttaaaacattcataattttgaacctgcagtcctatttttagcagaatacgcttaagaaaaatatcagaaatttgaatagaatttttcccagtattatctgtaattcatagacattccatttacataaaggaaaaagtctttattgtattaatttccggtgtggtgttttttgtttgtttgtttgtttgagacaagagacaaggtctcactctgtcacccaggatggagagcagtggtgcaatctcagctcactgcagcctcaacctcctgggctcaacccatctttttcacctctgcctcctgagtagctggaacaacaggcgagcgccatcggctaattttttttgtattttttgtagagacagggtttcaccatgttgcccacactggtctcaaactcctaggctcaagcagtccctggtcttggcctcccaaagtgctgggattacaggcatgtgccactgcgtatggcatatttatgttcttattgtcagaactcttacagaatttttttctaacaatctatatatgcaaataaggtgcttctgacttttgtcagtaatttaacagtaaacacattacaggtttttaactgatgttttgatcttttacctgccaatctaggtcccttttgataagcagcatgcttttttttttgaggtagtggaccctgattaatagtttttactattaaaataagcttgaaagaacaaagctttttagcttgttaggctgttagaatcggtatctatgacttgtattcattgttgatatgctttaaccaagagaaccaatataaagtataatttaaaaagagaataataagagattcatttgactctcagcttaactggttcattcagtgtaattagagaattagttgctagatgaaatgatttttaggagaactaaaaattaaaagtaaactgtacagttttgttgagcttaatgctgtgtcttctttgcaatagattatgaaggttttaaaaataaatatctttgcaatagattgtgaaggttttaaaaataaatatctgcaaatataaacatattttctatagactaaagtagtgtgatatgttaattttttttaataggtcccgggattcttctgcatttccagtcaaacgactttggcatttccttgttaaacaagaggtccttcaagagacatttattagatatattttcactaagaaaagaaagcagagtgaggtattttgagaaaaatattttctattgtaatttttctttagttttctttaacatttctaaggaaatcagtgcttgatttattctgaaattttctttctggttgggtaatagtcaaagttcactaaactaccgtgaactacttttaagataaaaccttataattttcatttcatagcaatgaaacaacataggtactttgataaattacatatattcaagtgaaagttggtactttacagtatttgtcattaggtttttacacataataaacattgtgatggatggcttgaggaatttaatatataagcttactctataatattctccaaatatgtacttaaaatataaaatagccctttaaaagcattttctttacttagcacttagaaatgaacagaatgatgatttgaagcaacaaattcaggatacttttgtgagagaataaactacagaaatagcaaatacaagatgaaggaagattgctcttacaaagcaagacagaggttctgcattgcatggttatttttaagctaatacaattagtaatgtaatagcagacatggttcaagaagaattagcagtttgggagattggcaagtgacctcttccttataaaagtgggaccttttatatgagcatttcagtctgtttggctatttagtgaggtaattagtgagggaatgagcagtttgaagagtattcagagttgagcgtctgatgtaattaaagatttggcaaacatggccgggcacggtggctcacacctgtaatcccagcactttgggaggccgaggcgggcagatcacctgaagtcaggagttcatgaccagcctgaccaacatggagaaaccccatctctactaaaaatacaaaagattagccgggcgtggtggcgcatgtctgtaatcccagctgctcgggaggttgaggtaagagaattgcttgaacccgagaggcagaggttgcagtaagccaagattgtgccattgcactccagcctgggcaacaagagcgaaactctgtctcaaaaaaaataaagatttggcaaacacaatcaatgagaagagaagaaatgaattatatttcgcttagaaaagtgaaaacagagagagtccatacggctcaatttcccgagataaagtataaaattgcttctcagtttttcctcatgcccagggcagtggaacctaccatacttgttctttttcccactcacccacttacctgaatggtaattgtggtcagcccttatgaacagtcatttgttttctctatggatttaaaaattatatacttaaatgaggaagtagaagaatgaactgtagagaccttttgagtcctagttataagctttttcataacaaaagacccttatggcattgaaattattgatgtgactttgttagggaaatcagaggcaaattatttgcctctgtcatttaaaccactgtgtatagcatttcctatagtgatgctgagtccaaattccataaactaaaatataggaatctaagatagtgatttaaaataaaagattttagccaggcatagtggctcacacctgtaatcctagcactaggtgggggatctcctgagctcaggggtttgagaccagcttggcaacatggtgaaaccccgtctctacaaaagatacaaaacaattatccaggtgtgatggtgtatgcttgtaatcccagctacttgcagggctgaggcaggaggattgcttgagcccaggaggtggaggttgtagtgagctgagatcacacaccactgcactccatcctgggtaacaaagtgagaccctgtcttaatcaataagatttctggtcaattaggggctctgttattcacagaaaaccagttcattgagtgatcaattttctgagtgttttgttcttcaaattattaaaattaatgatttatcacaagtatgttttaagtattggtaaggttgatagcagcttgactggttgacttgtcagagtgtagagtgctgtgggaagccaggtgtctgggtttcttggaccctcccattctcgtcttgcccttccccacgagtttgcttcttccttaactaattctccccctctccgccccttagtctcccttccattatgcccctcagtctctgtgtgttctatttttcttccagcagtgggtccccatgaacagggaagtaggacagagataaacggaatgtttcttaaagtgctatataagcatcagttggctccaaggaagggaagtacatggctgggagttaggatggaagaatttttatcatgtacccttttaattttaaaacattgaatggaattactgtcttgtccagtactgtcccatagaactttctgtgatgatggaaatctgtatctgcatagtccaacatagtagtcaccagccacatgtggttactgagtacttgaaatgtggctagcatgattgagaaactgaattttaattttaattgatctaaatttaaatagttacatatggttagtgattgctgttttgaatagctcagatctgaaaaaaaaggtgttttattaagaaaaaaattatgaataaaacattaaggctgttaggacaaaataaaaactcgtcgttaggctcagaaatatgcaaaacttactaaaactctacccaatccagtaagagtgcttacatctttaaaattgtcaaataggattttggtaatcactaaatttggcaaattcagaaaattgaccaataaaattggcaggctaatcctaaaaatgctgggtgcatttaaaaaaaatccctgagaaatgctgaagttatatatttataagaataagatcttttattcactgaagatattacaggaaaatatttcacaaaacaagtttttgggaaacagattggtgaattcagctagttaagacaaatagattcttcagcagtttggccttcactgagttagctgtgccacacattgaccattccttggaagttttcttggatgcatctttatcagctgcagcagccataggggagtccctggaggcatgggcagaaaatttgaatggcccttcgtgatgaaaggaaggcagtcacctgaaaaggtatgaggaagagtttgtttctctgatcaaaccttcagagtttccacagcagagcagaaatataacttctgattgcagccatccttaggaccctgcatcaacccgggagcaaattactgagttatttctttttccgtgcctgattttattaaacatttatttacttagagaaaaatcatcatattccttataagagtgaaataattatcaatattttgaatctatgtttagaaataaatattttaatttgtattttaaatcaacccctatagggcaggaatttatgtagcatcttctgcatctgcttatacaaatgggctttaattttatagattaccagttatgtaacttagatttcttaaaactgtatacagataactaatttttattttgaaatagcttttatgttcttgtgtttatgtaatagtcacattaattttgctcttttggctttgtgttgtgtttatttgatgactgttttattcggtttaattttttcttgattttgcaaattcatttttatcatctttaagtggtggagtggccatttcagcttgaaatatttcactgtctttataatttcattccatgcatgtgttttgtgtttgtgacggtgtggtggtatttagtctatagaagaacatgtggagcaggtcaaccaaaactgcatagcagaagattgccacatcaaggtagtattccaagatcttgtatttagctcattctttaaagttcaaggagctaacgcctcatctctgatactaaccatgacctgcccaactggctaactactcagagaactcatagtactcccataccacttcagtggcacaggggaggagatgcttcactgtatctggcttgctctgtcttgcccttggttcttctctttcttgctccctgtcccatcttcacttgtcactttttctgttttaagcatggctgtttcatcttcttgattctgccttttctttccttcccatcaccaaccctaagccattgcatcttcctctcatcagtctcttttattcctttcgaagtatccctctttacaacttttccttatttctgtctcaccacccttacttcaaagggtggtttctttgcggttttctatggctttttactccactctgtgcctcttaatgtatacacattcttattgcagaatatttatgcacttttggaagagctaagagagacatactactgtataaattactaataaaaatatattagccatgttttataattaatcagtatcttaccatcacagtggaaattggggtgattacaggacatcagagaatttaagcaaattttccaaagctagttttcaacacattaaagttactcttacccttttttcttgctgctgctgctgctgctgctgctacattttcttcttatcctacatttaaatcttatgggatgtgcataactctaaatagagctgtgctgcagcaactaaaactgctgatgaatgttttctaggttgaagctgatctgggctatccaggtggaaaggcgaaagtcatccataaggaatctgatatgatcatggcattttctgttaataaggtaaaagctctcatcattatacacagtgtatttctccttagtgaaattgcttaaatcatcgattctgcctttgctttataggcaaattgtaatgaaattgttttggcttcaacacatgatgttcaagaacttgatgttacttctctactggcctgtcagtcatacatatggatcggagaagaatatgacagagaatccaaaaggtttgtctcatagtcacttttacatatagttttctgtaagaagtacccaccaaatggttatgcacatgatttgaattatttcaaaaggtatacgtgtatctccttcatttgggtaggtgacaaatataattggtttagctgccagtgaaagtctttgtctacattaactgaatgaattacacttccattaaaccctacactattgataatatttcaataaggataatccctaacacttggcttcatgatattcagtaaattaatctgatctggataattaaaacagtagacacaaatatgttaattacactgagtcacatttaccgagtaattttgcagtgtttcttcttatcacctgataagcataccttttcttaaacataaaaatgtagacggctttacttttcattgaagctatggacactgcaccaagagtgttttgccattcttacctattttgaggtttcttctttgtggtttgccttccctcctgcttttctccagactcttagaaattgttcatgcttgaggatggtgccatgatagtttctctcctcattttgttgaattcttttttttgttagtatgtgatataactaggatttaatatcacatttcagagtagatataaccatgtactatgatacaatccatcccaacaattactttcacattttatatgtcttactccaagaaatctttaaactcaaatttctttaaacgtgttaatttgatactgagctatctgtacttgaagagaacataatatttttccatagataacaacaaacttttgtttcaacttgtgcagcaataaagttgtccccaaacaacattagactaaatttacattttgccaaaagggaaaaaagttaaccagtattaacattggcgattaggacttgtacctaagtttttctcatggctacttagtttttaaaataaagattgtcctatgggtacataagaagatttttagttggaatttgtgttaagagaaaagggaatgttcacagtaacacatgaatgtttttcacagttcagatgatgttgattatcgtggttccactacaactctttatcaacccagtgcaacatcctattcagcaagtcaggtgcatccaccttcatctctgccatggctgggcactggacagactagcactggagctagtgtggtatgttatttacttataggtatcatttctggatttggactctgaaaaatcagttggaatctctttgacataggaatgatcctaaatttcagggacaaacaccagtagataggccatgataatgacagctgacatttattgtggcttttttatttggtgacagggtctggctctgtcgcgcaggctggagtgcagtggtgcaatttcggctcactgcagccttgacctcctgggctcaattgatccttccatctcaacctcccaagtagctgggactacaggtgcatgccagcgtgcctggctaatttttgtattttttgtagggatggggtttcaccacgctgcccaggctgttctcgaactcctgggctcaagtgatctacccgcttcagcctcccaaggtgctaggattacaggcatgagccaccacactggcctcatatgactttcttagtgtcagatacatgctttttctcacaacaatcctaggtggtaggtgctattattaccctccattatcattttacagatgaataaacagatacaaaatggtaaagcaaagttaaaggggaattcatgtctacttctaagtgcttgaaagcatgtcagtaacattcttgtcactgtagctggaggggtcccattcttatgttctgctctgaagcatctggaggtgctcctgaatatcctcagggaggggcacttgaagaagagttcctttattatgagatgaagctccttggtaacctcacaggccagggctataccagcaagtgactgtgcttcctcaccctcttcagacaagtgttctatgtagtggttcagaacatccataacaggctttatctcagtaataagcaaggtgtaagagaataaatgtcagaatttatcctgaagcatatccttcctcatcttttctgcatacacaaaataaaatttttaaaattttcttttaaagcttatgaaaaggaatctacataatgttaagagaatgacttcacacccagtccatcaatactgtaagtatttatgacctaataattgtaagtgtcctcatttggaggttgatttatagaatagaaaatattggaactctttaatttcttatttcctgctttttctcttgtgtttcagatcttacaggtgctcaggacggcagtgtacgaatgtttgaatggacgcggcctcagcaacttgtctgctttcgtcaagctggcaatgcaagagttactagattatattttaattcacaaggcaacaaggttagtttctgggggctactgctgaattcatctgaaaatagttgtggatatttaggagtaagtgataaaagtgcatcgaaaaatgaattcagtgaccctggatttaaactgagtagacagtttgttggagtctattcatacactctcttttcttccaatagaagcaaaaatctacaaaatttagtatggattaatcatctatttaaagatactaaatatactgtgagagtaaaaaaactgcctgtgttgagtgtgttggtgattcctgtaagcacagtaaagttcttgagagaaacctagtttcttactaaatttcatcagtaagaggttagaggaaaacagtgaaacaggtaagcagttaagaagtaatggaagggccagtcacagtggttcacacctgtaattacaacactttaggagcccaaggcaggaggattgcttgaactccagcatttgagacaacctgaacaacaaagggagaccacatccctacaaaaatttttttaaaaagcccaggcatgtgcctctagtcctagctactcagaaggttgaggctggaggatcccttgaacccaggagtttgaggttatagtaagttataattgcactactgcactccagcctgggtaacagaatgagaccctgtctctaaaaaaatttaaaaaaaaagtgacagggaattttttagcacttggactttttgggaatgacagcaacagaaacatagttagaggcagaatgtttatttagtagggccttagtgaatcttccttccatgtttttacctttgctgtggatgctaagaacatgtgtttagtagttatactgttcttacagtgtggtgttgcggatggagagggttttctgagtatctggcaagttaaccaaactgcatcaaatcctaaaccttatatggtaagtatcactaaatgttcccagggcgcatatacacaacactttgttcatgaagtgtctgtttcagacagtgaatctcattggtggtcctattgggaaaaggatgatttttttcagcaatcccagcctgacagcagcacccatccttaccctagttttagactgaaatgacctgaaaaacaaaaagccttgcttttcaccttgaagtacagtttatattttaaaaattttgggggctttccctgtgtgtggtacaacttgggttttttttcattattattatactttcatccattttgaaaactctatcttcttaatatacacatgataaaattctgtcattaagaatcaggttctgccgggcacggtggctcacgcctgtaatcccagcactttgggaggccgaggcgggcagatcacaaggtcaggagttcgagaccagcctgaccaacctggtgaaaccccctctctactaaaaatacaaaaattagccaggcatggtgacacgtgcatgaagtcccagctactcgggaggctgaggcaggagaatcgcttgaacccaggaggcggaggttgcagtgagctgagattgtgccactgcgctctagcttgggcaacagagtgagacttcgtctcagaaaaaaaaagaatcaggttccaaacatctgttccaatttgttccagaattgtgcttaccagattataaaataaccaatcccaatgagccaccttaatccaaattggattacaaaatagttggtgatgaagataagtagatctttacctgatggagatatggtgggggaaaggaacatgggggagggtggaaggtgatgctgtcctgtgtgaaacttcaggcttcacatatatggagggaggttcagaacgccttgaacctcctgggaccagatagattacccaaatactttttaaaatttttctaaactatacatatgttcttaattatgtgtataagataattctcttaaattaggacactatagactgtaccttgtctatgcagaaatggaagtaatcttgaatttatacttttgtcttcagtcagatctgtaccactataattccagacagaaaaacatgcattatattttaaaataccttgacatcctaagactagttgggtctgtaagcatttcctttgtgactgttaaagtttattacatgtatttgagatcattagcactaaaattgacgggtcttaggtaggttcatgtactttgatgtcctattcttacataatctgaaaaacatgacctttaattctgtttttaccaactccagttattaaaaattattggacagtagccaaataatatacacatgacagttaagcctcatactatcacttattcttttatcctagaccgagtttttaaaaactatttttagctcatgcatatagtatgttattagcagacatgtatgttggtactgtatcaaattttatccaatggtaaaataacatcagttgcactttgtttttcgtagagttggcagtgccacagtaaagccacaagtgactttgcatttattacctcttcaagtctagttgccacatctggacactccaatgacaataggtaggttgacagaaaagcaaagtaagaaatataaaaacgttagaaatccatacctttagcaagaatacttttctattagtagggtttttccactctaggcattaaaaaaaaaaactttgttacataattcttatttcagagtgttttttcttaccaaaaagagaaaagcaaaaatgaaagttattcctaatatatgtaatttttattttaaagctattcagtcttttttaaactactactgttaacactgttagtttctctaggactaacaggcatctgatattgtctccatcattctcaacatttttattttattgcagtaggtttgggggaataggtagtgtttggttacatggataagttctttagtggtgattgctgagattttggtgcacccatcacctgagcagtgtacactgtacccagtgtgtagtcttttattcttcaccctcctcccacccctcccaagcccccagagtccattatatatcattctgatcctttgcatcctcatagcttagctcccacttacaagtgagaacatacgacatatgattttctactcctgagttacttcacttagaataatggcctctaactccatctgggttgctgcaaaatgtgattatctcattcctttttatgaagtattccatggtgtatatgtaccacattttctttatccatttgttggttgatggacatttaggttggttccatagttttgcaattgtgaattgtgctgctctaaacaggcatgtgcaagtgtctttttcatataatgacttcttttcctctgggtagatacccagtagtgggattgctggattgaatggtagttctgcttatagttctttaaggaatctccgtatactgtttttcatggtggttttactagtttacattcccaccagcagtgaggtgtccccttttcaccacctccatgccagcgtctattgttttttggttttttaattatggccattcttgcaggaataaggtggtatcgtattggagttttaatttgcattttcctggtaattagtggttttgagcattttttcctgtttgttggccatttgtattttgagaattatctgttcatgtcctttgctcgcttttgatgggattgttttttcttgttaagttccttgtagattctagatataagtcccttgtcagatatatacattgtattttctcccactctgcaggttgcctttttactcttgctgtgcagaagtgttttagtttaattaggtcccatttatttatttttgttgcatttgcctttgggttcttggtcatgaattctttaagtcaatgtctagagtagttttttttgatgttatcttctagaatttttatggtttcaagtgttagatttaagtttgacccatcttgagttaatttttgtataaggtgagagatgaggattcagggactaacaggtatttgacactgtccccatcattctcaacatttattttgacctcacatggttttcattagcaacacatgcccatgaataacatcttgtttccctgcagtggctaccacctggggatataaaagcattccttatactcaggaagtcatatcagtttcctggagtggcaatggaaaggagatggggtagaggatgcagagacgggcaggaccatgtgagatggaactgtgtagtttgaccctacccccatcctagttgggaatcactactctctataggtgtgagtgaacaaaaaagataagaatgaataagcaaaatatttgactgaaagacaggttgtccctgatgacgacttataacaatcatttatgatgtatttttgttattgtgtttctttaaaagaaatgtttgcctctgggacacattaatatcacccggaaacagcctcattcatggtgagttaaggtctatgatttttaaaaatataccatgaaggaataatacaccatgaaggaatgctttcttggttttaattagtgaatccagtgagtgtttattgacaggttgaaaatggagaaatatttagaatgaatgactaaaaatttggaaagttaattagcatatctggcttccttgctgagttaaagatatatggtctcagaaatccaaaatagtctttatattctattcagaaaatatggtatggatagtggtactactaacaaggctatttaagaaattagttgcaaagtattcattgagcttaatagaaaataacatattttaaagaattaaacctcatcataaaatactttttgtctttttttcctttttgtggagatcaaggtcatgctgtattgctcaggcaggtctcaagctcctagggtcaagctatcctcccacctctacctccctaagtactgggattacaagcatgagccaccacacctggccctaaccataaaataaaacaaaggttaaccttattataatgactagaaatgtaaacagtgccatttaaatattattccttttaagacaatacttgccaaattagtgtcctaactctgtcttccacatagtaccacccaaaaagtgctccatgctcaagtaagtttggttaaatgaagtagattgtcagaaagacagaaagattctcagtcttttaatacactgatatgcattttgaaatatgtagttaattctcaattttattgcagaattctgcaaacagtggttaacattgcttacagattttctgcatgttaatttgaatctttaatcatattaaaatgcaaatactcctgggaaggataatgaacttcttaacttgtaactgaaaacattcacacattttctcatagtgtcgttgtttcaattacttacctgaaaagaactttttgtacggtacagcacttggctgggttaatactcaccaactttgagaaggttggtctctgctcttctgtatactttttatgaggcagtatcacttagggcttaaggtttaaactttctttttctctctgtgttcatttcatattgagattatggataaaaagtttgttctgacattgcttaacatttttctttaatcatgtgattacagaaattcaatgacttacaaaacaataaatgtaccttagaatgaaaaatgcatcagtaaggtctgtatttaaatgtggatgtagacatcataattaccaagacaagaaattgttttgagaaattctctgatgtttttcttcttcaggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtgagtcagtacaagaggttggaatgtgctaaagactgattggaaagagaaaaaacaaaaactccacattctttgaaataaagcttcactttatttcacttgggctactgcatggagatactgcatatctcaacactctgccgcctccccatgctcctgtatggttctttctaaactgttatggtcaatgagattatcaaactcattggactcaggccattagaaagctttaaagcattctattttgagtaaagtgtatgagtttaatgcatgaaattttttgatgacattagtttggctccttagaagcttctcccctctccctcagtactcttgtgtgtggtggaggtgacgtttccagtaagtgagctagtgcagatgctccttgactttatggtgggattatgtcccaacaaacccattataagttaaaaatattgttaaagttgaaaaacatactttcaacttaatattttcaacttactatgagtttattgagactaacctcaggataagccaaggagcgtgctgaatgcgtattgctttcacactgtcataaagtcaaaaagtcttgtcaaaccatcgtaagtaggggactgtctgtaccacactacttttacatagccttaggacctagctcagcatgaggaacacatttaactgaattaactcaaatagttaattgaattagagatgggctacatatggttaatatgaagccacaagaggatgtgaaggaaaatatggaaggaggacagtaaatgaatcgtgggagtggtgttatcatttcccacttagataagctcttaggaaagaggcagtgggtgggaaggttgggctttagtgagatcacttgggccaagggagcagaagggccatgtttttgcttttggtcttttcgtaatatatttttaactccttttgttttgcactaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaatgtttaactgttagagaatttgcaagctatttggcagtctattcattcataagtaagtatttactgaataccttctataccaaaagccattctaggaaatgggatacagtggagagccagacagagaaagcacacaatgttgagatttagcggggcaagagctaacctcactataccttctccagacagatttgaagtttattgaatgaagtactaacctcgtacccaaaactcaaatctgagtcttggctatttgcttgctcctaagtaagtaagggaagtcagaatatgcccactgataagaagagccaggaaaataagcttgtgagtgacatctcaatgcctaaagcaaaactgattcaaaggagctttcagaaaaaagggaagagaactttctctgtcaggtaaaagcagtaagagactctagattcaccttctagcttgaaacaactaaaa

SEQ ID NO: 6248 - DNA, 17595 bp, Homo sapiens
gagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtaagaaagctcttataatgctgataaagagcgtagcttaacttttctggaagacagtttggctaaatatgccaatatactttaaaacattcataattttgaacctgcagtcctatttttagcagaatacgcttaagaaaaatatcagaaatttgaatagaatttttcccagtattatctgtaattcatagacattccatttacataaaggaaaaagtctttattgtattaatttccggtgtggtgttttttgtttgtttgtttgtttgagacaagagacaaggtctcactctgtcacccaggatggagagcagtggtgcaatctcagctcactgcagcctcaacctcctgggctcaacccatctttttcacctctgcctcctgagtagctggaacaacaggcgagcgccatcggctaattttttttgtattttttgtagagacagggtttcaccatgttgcccacactggtctcaaactcctaggctcaagcagtccctggtcttggcctcccaaagtgctgggattacaggcatgtgccactgcgtatggcatatttatgttcttattgtcagaactcttacagaatttttttctaacaatctatatatgcaaataaggtgcttctgacttttgtcagtaatttaacagtaaacacattacaggtttttaactgatgttttgatcttttacctgccaatctaggtcccttttgataagcagcatgcttttttttttgaggtagtggaccctgattaatagtttttactattaaaataagcttgaaagaacaaagctttttagcttgttaggctgttagaatcggtatctatgacttgtattcattgttgatatgctttaaccaagagaaccaatataaagtataatttaaaaagagaataataagagattcatttgactctcagcttaactggttcattcagtgtaattagagaattagttgctagatgaaatgatttttaggagaactaaaaattaaaagtaaactgtacagttttgttgagcttaatgctgtgtcttctttgcaatagattatgaaggttttaaaaataaatatctttgcaatagattgtgaaggttttaaaaataaatatctgcaaatataaacatattttctatagactaaagtagtgtgatatgttaattttttttaataggtcccgggattcttctgcatttccagtcaaacgactttggcatttccttgttaaacaagaggtccttcaagagacatttattagatatattttcactaagaaaagaaagcagagtgaggtattttgagaaaaatattttctattgtaatttttctttagttttctttaacatttctaaggaaatcagtgcttgatttattctgaaattttctttctggttgggtaatagtcaaagttcactaaactaccgtgaactacttttaagataaaaccttataattttcatttcatagcaatgaaacaacataggtactttgataaattacatatattcaagtgaaagttggtactttacagtatttgtcattaggtttttacacataataaacattgtgatggatggcttgaggaatttaatatataagcttactctataatattctccaaatatgtacttaaaatataaaatagccctttaaaagcattttctttacttagcacttagaaatgaacagaatgatgatttgaagcaacaaattcaggatacttttgtgagagaataaactacagaaatagcaaatacaagatgaaggaagattgctcttacaaagcaagacagaggttctgcattgcatggttatttttaagctaatacaattagtaatgtaatagcagacatggttcaagaagaattagcagtttgggagattggcaagtgacctcttccttataaaagtgggaccttttatatgagcatttcagtctgtttggctatttagtgaggtaattagtgagggaatgagcagtttgaagagtattcagagttgagcgtctgatgtaattaaagatttggcaaacatggccgggcacggtggctcacacctgtaatcccagcactttgggaggccgaggcgggcagatcacctgaagtcaggagttcatgaccagcctgaccaacatggagaaaccccatctctactaaaaatacaaaagattagccgggcgtggtggcgcatgtctgtaatcccagctgctcgggaggttgaggtaagagaattgcttgaacccgagaggcagaggttgcagtaagccaagattgtgccattgcactccagcctgggcaacaagagcgaaactctgtctcaaaaaaaataaagatttggcaaacacaatcaatgagaagagaagaaatgaattatatttcgcttagaaaagtgaaaacagagagagtccatacggctcaatttcccgagataaagtataaaattgcttctcagtttttcctcatgcccagggcagtggaacctaccatacttgttctttttcccactcacccacttacctgaatggtaattgtggtcagcccttatgaacagtcatttgttttctctatggatttaaaaattatatacttaaatgaggaagtagaagaatgaactgtagagaccttttgagtcctagttataagctttttcataacaaaagacccttatggcattgaaattattgatgtgactttgttagggaaatcagaggcaaattatttgcctctgtcatttaaaccactgtgtatagcatttcctatagtgatgctgagtccaaattccataaactaaaatataggaatctaagatagtgatttaaaataaaagattttagccaggcatagtggctcacacctgtaatcctagcactaggtgggggatctcctgagctcaggggtttgagaccagcttggcaacatggtgaaaccccgtctctacaaaagatacaaaacaattatccaggtgtgatggtgtatgcttgtaatcccagctacttgcagggctgaggcaggaggattgcttgagcccaggaggtggaggttgtagtgagctgagatcacacaccactgcactccatcctgggtaacaaagtgagaccctgtcttaatcaataagatttctggtcaattaggggctctgttattcacagaaaaccagttcattgagtgatcaattttctgagtgttttgttcttcaaattattaaaattaatgatttatcacaagtatgttttaagtattggtaaggttgatagcagcttgactggttgacttgtcagagtgtagagtgctgtgggaagccaggtgtctgggtttcttggaccctcccattctcgtcttgcccttccccacgagtttgcttcttccttaactaattctccccctctccgccccttagtctcccttccattatgcccctcagtctctgtgtgttctatttttcttccagcagtgggtccccatgaacagggaagtaggacagagataaacggaatgtttcttaaagtgctatataagcatcagttggctccaaggaagggaagtacatggctgggagttaggatggaagaatttttatcatgtacccttttaattttaaaacattgaatggaattactgtcttgtccagtactgtcccatagaactttctgtgatgatggaaatctgtatctgcatagtccaacatagtagtcaccagccacatgtggttactgagtacttgaaatgtggctagcatgattgagaaactgaattttaattttaattgatctaaatttaaatagttacatatggttagtgattgctgttttgaatagctcagatctgaaaaaaaaggtgttttattaagaaaaaaattatgaataaaacattaaggctgttaggacaaaataaaaactcgtcgttaggctcagaaatatgcaaaacttactaaaactctacccaatccagtaagagtgcttacatctttaaaattgtcaaataggattttggtaatcactaaatttggcaaattcagaaaattgaccaataaaattggcaggctaatcctaaaaatgctgggtgcatttaaaaaaaatccctgagaaatgctgaagttatatatttataagaataagatcttttattcactgaagatattacaggaaaatatttcacaaaacaagtttttgggaaacagattggtgaattcagctagttaagacaaatagattcttcagcagtttggccttcactgagttagctgtgccacacattgaccattccttggaagttttcttggatgcatctttatcagctgcagcagccataggggagtccctggaggcatgggcagaaaatttgaatggcccttcgtgatgaaaggaaggcagtcacctgaaaaggtatgaggaagagtttgtttctctgatcaaaccttcagagtttccacagcagagcagaaatataacttctgattgcagccatccttaggaccctgcatcaacccgggagcaaattactgagttatttctttttccgtgcctgattttattaaacatttatttacttagagaaaaatcatcatattccttataagagtgaaataattatcaatattttgaatctatgtttagaaataaatattttaatttgtattttaaatcaacccctatagggcaggaatttatgtagcatcttctgcatctgcttatacaaatgggctttaattttatagattaccagttatgtaacttagatttcttaaaactgtatacagataactaatttttattttgaaatagcttttatgttcttgtgtttatgtaatagtcacattaattttgctcttttggctttgtgttgtgtttatttgatgactgttttattcggtttaattttttcttgattttgcaaattcatttttatcatctttaagtggtggagtggccatttcagcttgaaatatttcactgtctttataatttcattccatgcatgtgttttgtgtttgtgacggtgtggtggtatttagtctatagaagaacatgtggagcaggtcaaccaaaactgcatagcagaagattgccacatcaaggtagtattccaagatcttgtatttagctcattctttaaagttcaaggagctaacgcctcatctctgatactaaccatgacctgcccaactggctaactactcagagaactcatagtactcccataccacttcagtggcacaggggaggagatgcttcactgtatctggcttgctctgtcttgcccttggttcttctctttcttgctccctgtcccatcttcacttgtcactttttctgttttaagcatggctgtttcatcttcttgattctgccttttctttccttcccatcaccaaccctaagccattgcatcttcctctcatcagtctcttttattcctttcgaagtatccctctttacaacttttccttatttctgtctcaccacccttacttcaaagggtggtttctttgcggttttctatggctttttactccactctgtgcctcttaatgtatacacattcttattgcagaatatttatgcacttttggaagagctaagagagacatactactgtataaattactaataaaaatatattagccatgttttataattaatcagtatcttaccatcacagtggaaattggggtgattacaggacatcagagaatttaagcaaattttccaaagctagttttcaacacattaaagttactcttacccttttttcttgctgctgctgctgctgctgctgctacattttcttcttatcctacatttaaatcttatgggatgtgcataactctaaatagagctgtgctgcagcaactaaaactgctgatgaatgttttctaggttgaagctgatctgggctatccaggtggaaaggcgaaagtcatccataaggaatctgatatgatcatggcattttctgttaataaggtaaaagctctcatcattatacacagtgtatttctccttagtgaaattgcttaaatcatcgattctgcctttgctttataggcaaattgtaatgaaattgttttggcttcaacacatgatgttcaagaacttgatgttacttctctactggcctgtcagtcatacatatggatcggagaagaatatgacagagaatccaaaaggtttgtctcatagtcacttttacatatagttttctgtaagaagtacccaccaaatggttatgcacatgatttgaattatttcaaaaggtatacgtgtatctccttcatttgggtaggtgacaaatataattggtttagctgccagtgaaagtctttgtctacattaactgaatgaattacacttccattaaaccctacactattgataatatttcaataagggataatccctaacacttggcttcatgatattcagtaaattaatctgatctggataattaaacagtagacacaaatatgttaattacactgagtcacatttaccgagtaattttgcagtgtttcttcttatcacctgataagcataccttttcttaaacataaaaatgtagacggctttacttttcattgaagctatggacactgcaccaagagtgttttgccattcttacctattttgaggtttcttctttgtggtttgccttccctcctgcttttctccagactcttagaaattgttcatgcttgaggatggtgccatgatagtttctctcctcattttgttgaattcttttttttgttagtatgtgatataactaggatttaatatcacatttcagagtagatataaccatgtactatgatacaatccatcccaacaattactttcacattttatatgtcttactccaagaaatctttaaactcaaatttctttaaacgtgttaatttgatactgagctatctgtacttgaagagaacataatatttttccatagataacaacaaacttttgtttcaacttgtgcagcaataaagttgtccccaaacaacattagactaaatttacattttgccaaaagggaaaaaagttaaccagtattaacattggcgattaggacttgtacctaagtttttctcatggctacttagtttttaaaataaagattgtcctatgggtacataagaagatttttagttggaatttgtgttaagagaaaagggaatgttcacagtaacacatgaatgtttttcacagttcagatgatgttgattatcgtggttccactacaactctttatcaacccagtgcaacatcctattcagcaagtcaggtgcatccaccttcatctctgccatggctgggcactggacagactagcactggagctagtgtggtatgttatttacttataggtatcatttctggatttggactctgaaaaatcagttggaatctctttgacataggaatgatcctaaatttcagggacaaacaccagtagataggccatgataatgacagctgacatttattgtggcttttttatttggtgacagggtctggctctgtcgcgcaggctggagtgcagtggtgcaatttcggctcactgcagccttgacctcctgggctcaattgatccttccatctcaacctcccaagtagctgggactacaggtgcatgccagcgtgcctggctaatttttgtattttttgtagggatggggtttcaccacgctgcccaggctgttctcgaactcctgggctcaagtgatctacccgcttcagcctcccaaggtgctaggattacaggcatgagccaccacactggcctcatatgactttcttagtgtcagatacatgctttttctcacaacaatcctaggtggtaggtgctattattaccctccattatcattttacagatgaataaacagatacaaaatggtaaagcaaagttaaaggggaattcatgtctacttctaagtgcttgaaagcatgtcagtaacattcttgtcactgtagctggaggggtcccattcttatgttctgctctgaagcatctggaggtgctcctgaatatcctcagggaggggcacttgaagaagagttcctttattatgagatgaagctccttggtaacctcacaggccagggctataccagcaagtgactgtgcttcctcaccctcttcagacaagtgttctatgtagtggttcagaacatccataacaggctttatctcagtaataagcaaggtgtaagagaataaatgtcagaatttatcctgaagcatatccttcctcatcttttctgcatacacaaaataaaatttttaaaattttcttttaaagcttatgaaaaggaatctacataatgttaagagaatgacttcacacccagtccatcaatactgtaagtatttatgacctaataattgtaagtgtcctcatttggaggttgatttatagaatagaaaatattggaactctttaatttcttatttcctgctttttctcttgtgtttcagatcttacaggtgctcaggacggcagtgtacgaatgtttgaatggacgcggcctcagcaacttgtctgctttcgtcaagctggcaatgcaagagttactagattatattttaattcacaaggcaacaaggttagtttctgggggctactgctgaattcatctgaaaatagttgtggatatttaggagtaagtgataaaagtgcatcgaaaaatgaattcagtgaccctggatttaaactgagtagacagtttgttggagtctattcatacactctcttttcttccaatagaagcaaaaatctacaaaatttagtatggattaatcatctatttaaagatactaaatatactgtgagagtaaaaaaactgcctgtgttgagtgtgttggtgattcctgtaagcacagtaaagttcttgagagaaacctagtttcttactaaatttcatcagtaagaggttagaggaaaacagtgaaacaggtaagcagttaagaagtaatggaagggccagtcacagtggttcacacctgtaattacaacactttaggagcccaaggcaggaggattgcttgaactccagcatttgagacaacctgaacaacaaagggagaccacatccctacaaaaatttttttaaaaagcccaggcatgtgcctctagtcctagctactcagaaggttgaggctggaggatcccttgaacccaggagtttgaggttatagtaagttataattgcactactgcactccagcctgggtaacagaatgagaccctgtctctaaaaaaatttaaaaaaaaagtgacagggaattttttagcacttggactttttgggaatgacagcaacagaaacatagttagaggcagaatgtttatttagtagggccttagtgaatcttccttccatgtttttacctttgctgtggatgctaagaacatgtgtttagtagttatactgttcttacagtgtggtgttgcggatggagagggttttctgagtatctggcaagttaaccaaactgcatcaaatcctaaaccttatatggtaagtatcactaaatgttcccagggcgcatatacacaacactttgttcatgaagtgtctgtttcagacagtgaatctcattggtggtcctattgggaaaaggatgatttttttcagcaatcccagcctgacagcagcacccatccttaccctagttttagactgaaatgacctgaaaaacaaaaagccttgcttttcaccttgaagtacagtttatattttaaaaattttgggggctttccctgtgtgtggtacaacttgggttttttttcattattattatactttcatccattttgaaaactctatcttcttaatatacacatgataaaattctgtcattaagaatcaggttctgccgggcacggtggctcacgcctgtaatcccagcactttgggaggccgaggcgggcagatcacaaggtcaggagttcgagaccagcctgaccaacctggtgaaaccccctctctactaaaaatacaaaaattagccaggcatggtgacacgtgcatgaagtcccagctactcgggaggctgaggcaggagaatcgcttgaacccaggaggcggaggttgcagtgagctgagattgtgccactgcgctctagcttgggcaacagagtgagacttcgtctcagaaaaaaaaagaatcaggttccaaacatctgttccaatttgttccagaattgtgcttaccagattataaaataaccaatcccaatgagccaccttaatccaaattggattacaaaatagttggtgatgaagataagtagatctttacctgatggagatatggtgggggaaaggaacatgggggagggtggaaggtgatgctgtcctgtgtgaaacttcaggcttcacatatatggagggaggttcagaacgccttgaacctcctgggaccagatagattacccaaatactttttaaaatttttctaaactatacatatgttcttaattatgtgtataagataattctcttaaattaggacactatagactgtaccttgtctatgcagaaatggaagtaatcttgaatttatacttttgtcttcagtcagatctgtaccactataattccagacagaaaaacatgcattatattttaaaataccttgacatcctaagactagttgggtctgtaagcatttcctttgtgactgttaaagtttattacatgtatttgagatcattagcactaaaattgacgggtcttaggtaggttcatgtactttgatgtcctattcttacataatctgaaaaacatgacctttaattctgtttttaccaactccagttattaaaaattattggacagtagccaaataatatacacatgacagttaagcctcatactatcacttattcttttatcctagaccgagtttttaaaaactatttttagctcatgcatatagtatgttattagcagacatgtatgttggtactgtatcaaattttatccaatggtaaaataacatcagttgcactttgtttttcgtagagttggcagtgccacagtaaagccacaagtgactttgcatttattacctcttcaagtctagttgccacatctggacactccaatgacaataggtaggttgacagaaaagcaaagtaagaaatataaaaacgttagaaatccatacctttagcaagaatacttttctattagtagggtttttccactctaggcattaaaaaaaaaaactttgttacataattcttatttcagagtgttttttcttaccaaaaagagaaaagcaaaaatgaaagttattcctaatatatgtaatttttattttaaagctattcagtcttttttaaactactactgttaacactgttagtttctctaggactaacaggcatctgatattgtctccatcattctcaacatttttattttattgcagtaggtttgggggaataggtagtgtttggttacatggataagttctttagtggtgattgctgagattttggtgcacccatcacctgagcagtgtacactgtacccagtgtgtagtcttttattcttcaccctcctcccacccctcccaagcccccagagtccattatatatcattctgatcctttgcatcctcatagcttagctcccacttacaagtgagaacatacgacatatgattttctactcctgagttacttcacttagaataatggcctctaactccatctgggttgctgcaaaatgtgattatctcattcctttttatgaagtattccatggtgtatatgtaccacattttctttatccatttgttggttgatggacatttaggttggttccatagttttgcaattgtgaattgtgctgctctaaacaggcatgtgcaagtgtctttttcatataatgacttcttttcctctgggtagatacccagtagtgggattgctggattgaatggtagttctgcttatagttctttaaggaatctccgtatactgtttttcatggtggttttactagtttacattcccaccatcagtgaggtgtccccttttcaccacctccatgccagcgtctattgttttttggttttttaattatggccattcttgcaggaataaggtggtatcgtattggagttttaatttgcattttcctggtaattagtggttttgagcattttttcctgtttgttggccatttgtattttgagaattatctgttcatgtcctttgctcgcttttgatgggattgttttttcttgttaagttccttgtagattctagatataagtcccttgtcagatatatacattgtattttctcccactctgcaggttgcctttttactcttgctgtgcagaagtgttttagtttaattaggtcccatttatttatttttgttgcatttgcctttgggttcttggtcatgaattctttaagtcaatgtctagagtagttttttttgatgttatcttctagaatttttatggtttcaagtgttagatttaagtttgacccatcttgagttaatttttgtataaggtgagagatgaggattcagggactaacaggtatttgacactgtccccatcattctcaacatttattttgacctcacatggttttcattagcaacacatgcccatgaataacatcttgtttccctgcagtggctaccacctggggatataaaagcattccttatactcaggaagtcatatcagtttcctggagtggcaatggaaaggagatggggtagaggatgcagagacgggcaggaccatgtgagatggaactgtgtagtttgaccctacccccatcctagttgggaatcactactctctataggtgtgagtgaacaaaaaagataagaatgaataagcaaaatatttgactgaaagacaggttgtccctgatgacgacttataacaatcatttatgatgtatttttgttattgagtttctttaaaagaaatgtttgcctctgggacacattaatatcacccggaaacagcctcattcatggtgagttaaggtctatgatttttaaaaatataccatgaaggaataatacaccatgaaggaatgctttcttggttttaattagtgaatccagtgagtgtttattgacaggttgaaaatggagaaatatttagaatgaatgactaaaaatttggaaagttaattagcatatctggcttccttgctgcagttaaagattatggtctcagaaatccaaaatagtctttatattctattcagaaaatatggtatggatagtggtactactaacaaggctatttaagaaattagttgcaaagtattcattgagcttaatagaaaataacatattttaaagaattaaacctcatcataaaatactttttgtctttttttcctttttgtggagatcaaggtcatgctgtattgctcaggcaggtctcaagctcctagggtcaagctatcctcccacctctacctccctaagtactgggattacaagcatgagccaccacacctggccctaaccataaaataaaacaaaggttaaccttattataatgactagaaatgtaaacagtgccatttaaatattattccttttaagacaatacttgccaaattagtgtcctaactctgtcttccacatagtaccacccaaaaagtgctccatgctcaagtaagtttggttaaatgaagtagattgtcagaaagacagaaagattctcagtcttttaatacactgatatgcattttgaaatatgtagttaattctcaattttattgcagaattctgcaaacagtggttaacattgcttacagattttctgcatgttaatttgaatctttaatcatattaaaatgcaaatactcctgggaaggataatgaacttcttaacttgtaactgaaaacattcacacattttctcatagtgtcgttgtttcaattacttacctgaaaagaactttttgtacggtacagcacttggctgggttaatactcaccaactttgagaaggttggtctctgctcttctgtatactttttatgaggcagtatcacttagggcttaaggtttaaactttctttttctctctgtgttcatttcatattgagattatggataaaaagtttgttctgacattgcttaacatttttctttaatcatgtgattacagaaattcaatgacttacaaaacaataaatgtaccttagaatgaaaaatgcatcagtaaggtctgtatttaaatgtggatgtagacatcataattaccaagacaagaaattgttttgagaaattctctgatgtttttcttcttcaggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctaattaaggctctggccttggatccctatgaggaatattttaccacaggttcagcagaaggtaacataaaggtgagtcagtacaagaggttggaatgtgctaaagactgattggaaagagaaaaaacaaaaactccacattctttgaaataaagcttcactttatttcacttgggctactgcatggagatactgcatatctcaacactctgccgcctccccatgctcctgtatggttctttctaaactgttatggtcaatgagattatcaaactcattggactcaggccattagaaagctttaaagcattctattttgagtaaagtgtatgagtttaatgcatgaaattttttgatgacattagtttggctccttagaagcttctcccctctccctcagtactcttgtgtgtggtggaggtgacgtttccagtaagtgagctagtgcagatgctccttgactttatggtgggattatgtcccaacaaacccattataagttaaaaatattgttaaagttgaaaaacatactttcaacttaatattttcaacttactatgagtttattgagactaacctcaggataagccaaggagcgtgctgaatgcgtattgctttcacactgtcataaagtcaaaaagtcttgtcaaaccatcgtaagtaggggactgtctgtaccacactacttttacatagccttaggacctagctcagcatgaggaacacatttaactgaattaactcaaatagttaattgaattagagatgggctacatatggttaatatgaagccacaagaggatgtgaaggaaaatatggaaggaggacagtaaatgaatcgtgggagtggtgttatcatttcccacttagataagctcttaggaaagaggcagtgggtgggaaggttgggctttagtgagatcacttgggccaagggagcagaagggccatgtttttgcttttggtcttttcgtaatatatttttaactccttttgttttgcactaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaatgtttaactgttagagaatttgcaagctatttggcagtctattcattcataagtaagtatttactgaataccttctataccaaaagccattctaggaaatgggatacagtggagagccagacagagaaagcacacaatgttgagatttagcggggcaagagctaacctcactataccttctccagacagatttgaagtttattgaatgaagtactaacctcgtacccaaaactcaaatctgagtcttggctatttgcttgctcctaagtaagtaagggaagtcagaatatgcccactgataagaagagccaggaaaataagcttgtgagtgacatctcaatgcctaaagcaaaactgattcaaaggagctttcagaaaaaagggaagagaactttctctgtcaggtaaaagcagtaagagactctagattcaccttctagcttgaaacaactaaaa

SEQ ID NO: 6249 - DNA, 2332 bp, Homo sapiens
gaactcctcgatgaggaccatctacagtgcttttttttttctatctctctgtctctcagttctgctttcttctacagtatttgatgactggcatcccatttctataagctgggtccagaactttgggctcacaccttcctttgacgtgcaagtgccacagaccctgagatgtttcttcagatcagggtgccgctggcatccactgaacttgcttcagtttaagctgagcaccttcctgagaatcatttcattttatctttcattctgtagtgagaagaggcttcagcatgaatagtctagggacatgcaagatgtataaaatagaatggagttgtgaattaggttatatgagggagaaatttataaaaaatataaagcattgtaaagacaaatgcatgttacacaaaaccaggagaccacttcattttaagaggtacctgctggtctcagaagctttaagtgatttataatctagtcaacaataagtggcagatgaactgaaaatatatttgcatgaagttcttagttcagaggtaaagctaggatgctatgcatggcaacactggaagggaaagagcttttgaaatccaggtctgggcatttgctctaatcagaggtcaacatcttctctgccctcataacccactccccgccaggggtcctgtctcctagaccacacattagcagatataatatctgtcattctggtttctcattctctttccagaaaaatccagacatgattttattgcaagatggagagaaaaggagacagcatcacatgtcttatattagtcacaaaaactggatgggttttatttcaggcgctaattcttttgagaacacaagggaaactttgatcttaatctatttgatgtggttttaagtaaaggagcatcttgtgcttactttgaaagtgtttttttacttcgggcttggtcaaatattacattttgttccagagaaaaactcatttggaaggcagcatggagtatagaattagacatccctgggcttgaagcccatctcagccatgaactacctttatgactttcagctagttacttttcctcactcagcttcagtttcttcatttataaagcaagtgcctcaacatcgctttttgactctcttaatcttgtctacgcatttacagtagcccttttattactgattttttactactcctggccatggaatgacgagaagcccatgtgtcattctcagacgggggattttgattctaatgacagtcatggttgagaagtccactgtgttaaagtctcttcatttgaagcatctgatgtgaattttattttttgcttaaaccccagacatagatgttaagtttcaaaattatgtcatacattcactcccactacatactcattgaatgcttaccatgtacagactctgtgatagactatggaaatacatagaaagaaattccctgtttttaagaactttacctagtgtttagaaattgcatttaaaactgataattaaaatactatagaccttggcttaaaggatgcaccttgtaatctgtaatcatatttgtagttatatattgctttgaaaatacactgtagacagtaagacaaaaaaggaaataaaaagtacatgaattgcgaaggagaaaataaaattgtctttgttcacagatgacatgattgtctatgtagaaaatcccgaggaactgacaaaacaaacaaacaaacaaatctagaactaattagttctagattatagcaaggttgcaggatacaagcttaatacctgaaagtaaattcctttcctatataccagccatgaacaattggaatttgaaatcaaaatacaacaccattaatattattaccaaaagagagagagggagaaatatgtattatgctaacaaaagaagtaaaaaaggtatgtgagaaaaactacaaatctctgatgaaataaatcaaaggagatctaaattaatggaaagacaaactatgctaatggataagaaaactcaatcttgttatgtgtcagttcattccaatttgatccatagattcaatgcaatcctagaaagctactttgtggacatctgcaaactgattctaaggtttacacgaaaaggcaaaaagatgcaatagtcgaaacaatattgaagaagaacaaagaagtcggactcttcttgacttcaagtctttctataaagctacaataatcaaaatagtgtggcattggtgaaagaatagatagatcaaaaccaattcaatggagaaagggaaaagacagtctttttaacaaatggtgctggaactggagttccttatgaaaaagaaaaggaaag

SEQ ID NO: 6250 - DNA, 115 bp, Homo sapiens
tttttgtatattttagtagagacggggtttcaccgtgttagccaggatggtctcgatctcctgaccttgtgatccatccgccttggcctcccaaagtgctgggatgacaggcgtg

SEQ ID NO: 6251 - DNA, 115 bp, Homo sapiens
gctgaggcaggagaatcgcttgaatccaggaggcggaggttgcagtgagccaagatcgcgccactgtactccagcctggcaacacagcgagactccatctcaaaaaaaaaaaaaa

SEQ ID NO: 6252 - DNA, 2168 bp, Homo sapiens
aaagaaggcccctggctgtggcgccatgtgaaaaggatgaagacctccaggcccttctccctctgagtctccctccccctgatgaccctctggaagcctgctggctcctcctcaccctcactcacacttcaactcccagttggattggcctgtggacctacctgctgcgtctcagtaggagagaaagaatccagacctcaggaacttgacctcacagctccagggaattcaccacgtgggcgaacgggtagagtagaagatgctcagtgaacatgcgcactgaggtgggcgcccaaagagcatgcgcagtgagatgtgtgcttgccttaggggctgtggtgtccctccttgttccccctacccctgctctttcctccatcccttcctaggaccccactaaggactttggaatccatcctcccttgtgtgttttttttatgcctctgagactcaaatatctcaatatcaccgttcaaaactcactctgtgttcacctgaccctcctgccctctatggcccttgttcctcccttgtctgggcccctcaagggagcaagtgcatggtggtgttgctgacttctagtagaaggatgaggatctctatcaggccgtggaccaagtggcccaacccatcgaagtctgctcactttccctcatgttcactcacactcaacttctgggaggactgatctatggacctatctgatgtgttatagttagcaagaaagaagtcacaacatttcctcccacagctctgcagggacagaaggcagagagcatggcccacagggaacaggaatttgcataggaagggacatgcacattgagccagggactttcagggaatgccagagttttccctctgtcaccatgatagcagcagccactgccatcatactggctgcagcagggaagcccagccagagctgcatgctctgtggagccagcaaaagccagggacaagtgggatccccaccttttacaagttggggagggagcccctgggtgcccctgcagccacccaaactgcagttgaagacccagacttctggctctatggagcaggcaggatccctgccctcctgggtgcagctgtagccactggatccatggctgcagacccaggagctggggacaagtgggagccccaacccttcagagttggcgggtcaggagctccttgggtgcagctgcaacttccctccaaggtgcaggacccaggtgtgtctgtagcctgcaatctctgaagcctgggaaggcccccactgtccctggggagcagggaacaggggacactgtccctggggagcaggctcagaggtgtctgctcccactacctggtctctccctgctcccagcacccactatgatttcagagcaggttgtgggctgagcccctgcactctcacagctcagatgggcttgcacatgggcaggtcagccctggaatgccagccccctgccacctcagacccctccagaatttgggtgccaagaaacatgagaggggaagccaagggggtgctgagggcagctgggtagtgctctgcaggtccgagcagcctgggcaccatggactgcagtgggaggcagacagggtccagagcagaagggggtggtcctaggtaaggtcccaccttcaggccagggatgggccaggctgccaatcccagagaccagagtatggacttgtggtgccttttctaggcccacccatggactaatgtacatgcactttctcccctctgaggtccgtaaatgcctgggactcagccagagcagggcagaggatgggagacaatgggacaaccagctgcagagaggagctaccctctccagggcctcctctctgctgagagctgcagatgttggaaagacctgcctgcagagaggagacacactcttcagggcctcctctctgctgagagctgaacacttgacctgacgacctgcctaaagaggagctactgactgtggatctcctctgagctgttctaacactcaataaagctccacttgtttgcataccttattcttcccagatgcattaacaagaacttgaacaaaggtgccaccagacacagaggtttccagccagaaaattgactgcccaaagatcccatataacccgtacccacatccacagggcattttttagtaaaaaaaaaa

SEQ ID NO: 6253 - DNA, 1561 bp, Homo sapiens
gtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 6254 - DNA, 1561 bp, Homo sapiens
gtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 6255 - DNA, 1561 bp, Homo sapiens
gtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaaggtatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 6256 - DNA, 161 bp, Homo sapiens
tcctctcttggtctcagctgggcctggttctcccggggcaggagggagggggtgtgggtggggcctgaggccccgcagctgctgccttgtgcctgctgattggctccttgtggaggggcgtggtctctaccttataatagggagggcgtcttatcctctca

SEQ ID NO: 6257 - DNA, 285 bp, Homo sapiens
gggagggtctgttggggagagagcagggagggattcttggaagtggggaaggtgccagattgagtcttctccaatggttatggcttggtcttgggagggctccccctgttccaggattctggagcctcccgccttccctgcaggcctctgtggagggagcagggcggggggcttttgcactcctccctcccccaaccctgcagccttggggatctgtggaaacagcccctctattgttctgcctccagttggagtgtgagccctcggagggcctgcagctgctgc

SEQ ID NO: 6258 - DNA, 415 bp, Homo sapiens
cgccccggtgccagcaccttcctttttggtggtcaggggcagagccacctactcgctgggttaacttaagcaagttgtttgcctctctgggcttcagtttctccatccaaaaaacggggctgttgagaggacctgaggttgagttgactggtgcgtagcacagagcctggagcctcccttgctccctttagcgcgtgccttgccctgtcttttctgctcaggttgcccaggtcttttttctctagcaccttttttcctctcttggtctcagctgggcctggttctcccggggcaggagggagggggtgtgggtggggcctgaggccccgcagctgctgccttgtgcctgctgattggctccttgtggaggggcgtggtctctaccttataatagggagggcgtcttatcctctca

SEQ ID NO: 6259 - DNA, 285 bp, Homo sapiens; identical to SEQ ID NO: 6257

SEQ ID NO: 6260 - DNA, 285 bp, Homo sapiens; identical to SEQ ID NO: 6257

SEQ ID NO: 6261 - DNA, 415 bp, Homo sapiens; identical to SEQ ID NO: 6258

SEQ ID NO: 6262 - DNA, 1727 bp, Homo sapiens
aaatagaaaaacagaagagtagtgctttaagtaacccttgacactttacatcaatttacacatagacaataaatatgatcactattatacatatttatctagggtgggtagcgtggaactgtgaaaagagcaatagctttgaaccatgaagaccagcgttcaaatcccggctctccttttttctcattgggtcattttggggaaactacttaatagttaagtataggaagacagtcagaagactgggatctgggcaggatactaagaaggttgcaactgtatctgtaatggtaacttttgttttttcacctgaggaaaataaactaaaaataatgttttctaacatttagatattcaacacatggacaagtgtttaattattctttgtatattcctgttgtttgtaaaacagcttataatttttaaaactattttaaagggaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcacctttcagggatactgttaaaagttttcccacatcagctaggagttagctctagagggcttttaagatctttggccatcccgaaattctatgcttgaaacacgttttctcatagaaacgctcctaccaaaggccagtgagagaactatcactttgtgaagaatttcagaatgcccactagctctcctgtagccctaaaaggtaatgagagtctacctgttcagactgagagctccagctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccagggaactacaaccaggagcccagcttattttggattggggatggggatagacaagaagagatggggcagggagaagagacggctggtttattttacatacacatattttatttataatacatctctgtgtctaggcgtctctatgctgttctcataaaatctgaattatacaaataaaagtttaattcctggctgttttgaatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagtttgaccccatactgcatacgcatcaggtccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaaaaaaaaaaaaaa

SEQ ID NO: 6263 - DNA, 1729 bp, Homo sapiens
aaatagaaaaacagaagagtagtgctttaagtaacccttgacactttacatcaatttacacatagacaataaatatgatcactattatacatatttatctagggtgggtagcgtggaactgtgaaaagagcaatagctttgaaccatgaagaccaacgttcaaatcccggctctccttttttctcattgggtcattttggggaaactacttaatagttaagtataggaagacagtcagaagactgggatctgggcaggatactaagaaggttgcaactgtatctgtaatggtaacttttgttttttcacctgaggaaaataaactaaaaataatgttttctaacatttagatattcaacacatggacaagtgtttaattattctttgtatattcctgttgtttgtaaaacagcttataatttttaaaactattttaaagggaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcgcctttcagggatactgttaaaagttttcccacatcagctaggagttagctctagagggcttttaagatctttggccatcccgaaattctatgcttgaaacacattttctcatagaaacgctcctaccaaaggccagtgagagaactatcactttgcgaagaatttcagaatgcccactagctctcctgtagccctaaaaggtaatgagagtctacctgctcagactgagagctccggctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccagggaactacaaccaggagcccagcttattttggattggggatggggatagacaagaagagatggggcaggaagaagagacggctggtttattttacatacacatattttatttataatacatctctgtgtctaggcgtctctatgctgttctcataaaatctgaattatacaaataaaaagtttaattcctggctgttttgaatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagttcgaccccatactgcatacgcatcagggccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaaaaaaaaaaaaaat

SEQ ID NO: 6264 - DNA, 1333 bp, Homo sapiens
  misc_feature (36)..(36): n equals a,t,g, or c
gttgtttgtaaaacagcttataatttttaaaactanttttaaagggcaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcacctttcagggatactgttaaaagttttcccacatcagctaggagttagctctagagggcttttaagatctttggccatcccgaaattctatgcttgaaacacgttttctcatagaaacgctcctaccaaaggccagtgagagaactatcactttgtgaagaatttcagaatgcccactagctctcctgtagccctaaaaggtaatgagagtctacctgttcagactgagagctccagctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccatggaactacaaccaggagcccagcttattttggattggggatggggatagacaagaagagatggggcagggagaagagacggctggtttattttacatacacatattttatttataatacatctctgtgtctaggcgtctctatgctgttctcataaaatctgaattatacaaataaaagtttaattcctggctgttttgaatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagtttgaccccatactgcatacgcatcaggtccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaaaaaaaaaaaaaa

SEQ ID NO: 6265 - DNA, 646 bp, Homo sapiens
gttaaagctaaatggcttagaatgaatcatgtctaaatattctgtataccaatcctacctatattatagggccctaaaagaagggtcagacgaagtatgctctaagtggctctcagtactgaatattcacagattaagttttacaaaaaggtaaagttttgtgataaccctcagataaaacagaaacatatgacctatgttttgacataaaacatacgtatttggcctgttctgaaaaatatgtataattttcacacaccacattctaccaaggaaaatgtcaaccggagccaaccaacttggtgttccactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagagcactaatgacagagctattgcatcaggttgatt

SEQ ID NO: 6266 - DNA, 766 bp, Homo sapiens
tgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccgtctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggttttgttttacttatttgttttcttgcagctttaacaaacatcagcgctgcatgtggaaacttggaaaagaaaaaaaaagctttaacaaacaaaaacacacatacctgagatgcacacggcaacctactagctcatggcaaacaggcctatatgttgataacctctgcattgcttaggaaataaaacactgcagattcttgagcaaggggaagtgcttctatctttgttcttcctttttctcctagtacatataacatctttactctggtctcagaatgtttcttccaaaccttaatggctctccccttctttttccttaacttcttcattccacccctggaataacgttctagtccagactagaaatacaacgtaaataaagactcaatcaatgccaacagtaggaggaggattaccacccagct

SEQ ID NO: 6267 - DNA, 646 bp, Homo sapiens
gttaaagctaaatggcttagaatgaatcatgtctaaatattctgtataccaatcctacctatattatagggccctaaaagaagggtcagacaaagtatgctctaagtggctctcagtactgaatattcacaaattaagttttacaaaaaggtaaagttttgtgataaccctcagataaaacagaaacacatgacctatgttttgacataaaacatacgtatttggcctgttctgaaaaatatgtgtaattttcacacaccatattctaccaaggaaaatgtcaaccagagccaaccaacttggtgttccactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagagcactaatgacagagctattgcatcaggttgatt

SEQ ID NO: 6268 - DNA, 766 bp, Homo sapiens
tgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccatctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggtttcgttttacttatttgttttcttgcagctttaacaaacatcagcgctgcatggggaaacttggaaaagaaaaaaaaagctttaacaaacaaaaacacacatacctgagatgcacacggcaacctactagctcatggcaaacaggcctatatgttgataacctctgcattgcttaggaaataaaacactgcagattcttgagcaaggggaagtgcttctatctttgttcttcctttttctcctagtacatataacatctttactctggtctcagaatgtttcttccaaaccttaatggctctccccttctttttccttaatttcttcattccacccctggaataacgttctagtccagactagaaatacaacgtaaataaagactcaatcaatgccaacagtaggaggaggattaccacccagct

SEQ ID NO: 6269 - DNA, 1044 bp, Homo sapiens
aggtgcctgtgatcccagctacttgggaggtggagcttgcagtgagccaagatctcgccagtgtatgccagcctgggcaacagtgtgagacttggtctcaaaacaaacaaacaaacaaaaaaacctaagtcccttcgctgtcaaatccttaggggagtaaattctgtcatctctgggtacctgttttcctgacttttcaaggtgttgaaaagagccttatgattcagccaaactttccaacagctctgatgggcagtttatcctcactcccactctacccagctctgttcctttcttctcttccactgtgtctgaatttgacagggtcccagtctcagtggtactgttcaaagtgtttataatgttactcttctgggcaatttttgcttcatacgtctccatccaatcaatgcatttcaggtgttgtggcagagagatttttgggggtgctggtacaagcaagacaggaataacccttaagtcacaataaaggcctctgcagggagtttttacattcacttcattttagacatcctcatttccctttcctacatcatgtaatttgtgtgattttttttttttagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatactttaaattgcagtgtcctaagttttttaaattcctcttactatcattcccaacagtgcccacatttattcttg

SEQ ID NO: 6270 - DNA, 1044 bp, Homo sapiens; identical to SEQ ID NO: 6269

SEQ ID NO: 6271 - DNA, 318 bp, Homo sapiens
catctctctttataactaaaggttggactactctagaataacagatgtttacattctaggtaatagccattcattcaataactctttggaggccttttaaagagaccattttgtagcaaaatggttgtagattgtttatgattaaatggagaaaaatcacttcagatgttgaagcaatttttttggattttaagtttgcaggataacgatttttttcttattttccaaacctaggtacaagttagatgaaataaattctgagtaagtcaagttgactttgctgaaatatataacgtgacaaactctagcctcccttca

SEQ ID NO: 6272 - DNA, 370 bp, Homo sapiens
gttacttatatgggaagggtgggtaacaaggattggacagggttagattagacccctctgaaggtaccttgttttatagttgtaactttttttttttttgagatggagtcttgctctgtcacccaggctggagtgcagtggtgcgatctcagctcactgcaacctctgtctcgcgggctcaagtgattctcctgcctcagcctcctgagtagctggaattacaggcacctgccaccatgcccagctaatttgtgtatttttagtagaggtagggttttgccatgttggccaggctggtctcaaacacctgacctcaagtggctccacccgccttggcctcccagagtgctgggatcacaggtgaaagcca

SEQ ID NO: 6273 - DNA, 318 bp, Homo sapiens; identical to SEQ ID NO: 6271

SEQ ID NO: 6274 - DNA, 111 bp, Homo sapiens
agatggagtcttgctctgtcacccaggctggagtgcagtggtgcgatctcagctcactgcaacctctgtctcgcgggctcaagtgattctcctgcctcagcctcctgagta

SEQ ID NO: 6275 - DNA, 1974 bp, Homo sapiens
tgagttttcatccattggtgacaagatggtcagacttctagagaaataaggtagttttgtggtagaacaaactcttccttgtgggaggtatagtgggatttggggaatagggtttatgaaatggtccccagagtgggatggcttgccttttcaaactgggtttcccacccagcaagttaagttgacccattgcagtggattgagtggagggcaggtgaagggcaggtgttttcaagtcaaaggagttcaggtgaagggcaggtgcttttagtcaaaggagttccttagcattatttcctcctttatttggagatcagattgaagatgtaggggactagaatgcagttgtagtttgtggtgtttactttttatggaaaagtgcctcttatgtgaaaagtcttctgtgcttgatcctgggggtaggggggttataaaaatgtcatacctgggatcctgcccttaaggagttgatggtaggtaatgctttcctttggctttttgttcatcttgagtctgtgtatgttcagttatcttcagccatttcctgggcaatgggaaacatttctgttaaaacaaacttctgactttgatctgtgacttatatttctttttagataatgaagaaccactgggattagagggtgtataaaatacaataataagtatagtgtatgtaggaacctctgtacaaccaatttggtgacttttaggcaactcatttgactatttgactgtttgttacatgagtgtgcatttggctttgtttaaaattcctctataaagcacattttaaaaaatgacccagtacttagtatataagatgaactgccatttgtataattgatcatttaaaaatgcttattatacttttaatcaatcagtttccatgtttatgaaatgggaataattattatatctagctcatagaattgtcctgaagatgaaatttatatccatatatacataatgaagctctttagagcaatgtataactacatgccaactgttcaaaaaatattaatggctacatcactattaatattttaaaattagtactgtcattttcccttcctacatgactgaatgtaggaggtgactatttttgttataaaaggatttccaatgagatacctttgaatggtaaaatttcctatgcatttatttaaatgtttatatatatatgtctttaaagtatgaaagttaagtgcacttatacaaggcagattcaggtactaattaaactgctcatttagattacagaatgagggactgaaaattatatgtatttaattaggaattggattgattggtcttgactgctgttgtctttcagttcttttttattgttatacttcccatgtgtttgtctccttttctttttatcttttaaaaattgctttctgatttatttcctgttcagttttcagtaatgggtgtagaatagggcaagaacttatgttggtgcccgttgtttgaaccaggaaggagcaactgcatcagacagcctggggctcagttgggagggacttcagatcagtccctgcagagctgcctggcccagggaaccactgaattccagtttcctaactccaaatcggacagtttgtgggtctacactgtatgtacataatgaacattttaaggctcattcatccagtgttttccacatgctcccatttgtttagttctcctttttaaaaaccaataattatggaaaaatttagctatgtacagaaatagtagtgagaaaccccccacttagccatcatgcagcttcagcagttgatcatctcatagccagtcttgtttgctcaatactcccaaccatttcttttctcccattttattttgcaggaaatcccagacattatatcatttaatctaaaagtatttcaggatgtatctgtaagagatgaggactcaaaaatgcatacacacattttgagaacttcccagaaatgtaaaaaaaaaaaa

SEQ ID NO: 6276 - DNA, 90 bp, Homo sapiens
ttttttttttgagatggagtctcgctctgtcgcccaggctggagtgcagtggcacgatctcagctcactgcaacctctgcctcccggatt

SEQ ID NO: 6277 - DNA, 9728 bp, Homo sapiens
caaagcagttctttgcaaacctttaacaatgacaaaagctacttactgtaaacctcacatgcagaccaaatcttgtcagacaggtaacttaggacaatgtgacttacatacttccccataccttcatctcacctaatgaaatacatgcttttcttgaatgacacctccaggatagattcatttggtcaatttgtcattttctgttgattttgcttacgtaattttagatattacctggagaatacagcatctcattttaaatcattatgatcaatctctgataaaggcctagaatacaaattatgtcaaaagtgaaaaaatactatctcgaaaatttccttggggataagactactaaaattataatgcttcctctgagaaaatcatctctttgcatgtggtttgtaatggtaacagttctgtttccttcctgtcagaatgaggtgaaattgttcaaatatgtattttttatgaaatttacagtgttacctgtgtattctaattatttgattaaataagcctttggggaggttgttgaggagagtatggtagggtatctggaactacatagtgtttttaaaggatgttttctttcttaaaaaaaaaaaatccctaaattctatttgtattttctgtaagttagaacagctgctgctttcttttttgtcctgttctttttaagttacctaacttaaaaaaactgggaattaaaaaaaaaaaggtactgaggtagttaaatttttctttatcaaattattttaacattgagcacctgtatataagtgttagttaacattgctccttaaatatgttttgtgtttttagatgatacttggaggacagaatatgttccagtgcctatccctgtgcctgtgtatatcccagttcctatgcacatgtacagtcagaatattcctgttcctactacagttcctgttcctgtaagtcacattttaagttctttctcattttgagatttagcagacacagttgggaaaacagtgtacagttgacccttgaacaacaagagtttgaactccatgcatccacatatgtggatgattttttttttttcccaataaatatgggcggccctctatattggcaggttccacatccgtgaccaaacacagactgaaaatacagtattctgcctgtaatcccagcactttgggaggctaaggtaggcgtatcttcagcccaggagttcaagaccagcctgggcaacatggtgacaccctgtctctactaaaaatgtaaaaattagccaggcacagtggcatatacctgtaatcccagctacttgggaggctgaggtaggaagattgcttgagcttgggagatggaggctgcaatgagccgtgattgcaccactgcactgcagcctggtctacaaagcaagtccttatctcaaaaaaaatgaaaataaaaaattatttgaggatgtgaaatctgtgtagaaggctgactgtaggggtgtggaacttgagtatgcatagactttggtatccatccacaggtggtcctggaaccaatcccctagaatactgaggataactctagttgcagttactagtttaatgaagctaataaaaccatctttacctttcttcgacagttaacttagatttggttgaatctctgttgtcatgattgattgctttgtgtatagtatgtatatgttcatcctcgagagtgacatttcgcggatgtctgtgcctgctctgtgcatattaagtttatatttgggttcattttcaaaaggaatatttgtgggccatgtgcagtggctcacgcctgtaatcccagcactttaggaggctgacatgggcagatcacctgaggtcaggagttcaagaccagactggccaacatggtgaaaccccctctctactaaaaatacaaaattagttgggcatggtggcacatgcctgtaatcccagctgctggggaggctgaggcaggagaatcgcttgaacccgggaggcggaggttgcagtgaactgagatagcgccattgcactccagcctgggcaacaagagtgaaattccatctcaaaaaaaaaaaagaaaaatatttgtgaagccataaggtttagaactgaaacatagaatttcatataaaatattattttatcccaaatcacttgcagtacttagaagaacactgtgtcagggcttggctattatagtcccctgggggacagaaatacttcaaaaattctttttctttaatttgaattccaaaaagtagatgcttgtattctaggctttcttatcacagttaacatcttagttttgtatgtgttcttttcaaagcttttatccagtgtgatattacaaagtagatcatgtgtcagagtaatttttaatttggaaaaataccttttaatgtttagtaaacctaactcaaaatgatttggttaattaggtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgagctacactaaattataccttgcgaataagtgttaacattggttatttataagtattgttacagtactttccagggcatatcattttgtttcaacttatgtgggggtgaggaaagcattgtaacaaaaatgttttttatattaagagatctacactgtatttagccaggtgccctcagacagatatccgaagcaggaatttggtctttggtctctgttttaagcaggatttgacttgtaaaatcaactcaaaattattcttgttaatggagtagtgctgatgcaaaactataataacttgtagtagactctaatgatgatcaaaactcttattttgtaatagttatccctagttttttgttttgttttgtttttttttttagatgaactcttgctctgttgcccagggtggagtgtagtagcatgatcccggttcactgagatctctgcctcctgggttcaagctatgcttctgcctcagcctcctgagtagctggaattacaggcacgtgccaccacgcccagccaatttttgtctttttagtagagacagggcttccctatgttggccaggctgatctcaaactcctgacctcaggtgatccacctgcttcccaaagtgctggtattacaggtgtgagctaccacacccagcccctagttttcttttattgcttatactaataaaataatttgcattatctaaaccagagtttatcttaacctctgttagggcagtgcttgcgctacatggtataacgtgatgagtgtgttgtggatggttctaagtcacttagaatatttattttccacccttaaccctctcttgatacccaaagtcctatttcaaccttgagctaattcttacccttaccctagaggacaatcaaaatactataattttctctggatttaataatgagacagtgtttttgaagcactgtggtaaggagttgtgaaattagtgggttgcaaccagtgtttttgtttaagaaaagaaaaagctaagtggaatagggtaagagaaatgacagtgtgaatccctcatagaaagggtaagtattattttgtgaaaccagtgtgtatacagatgtctttctgttccccaccatcaccttgcagtatgtgctggataaaatgcatttcttgccatgattacaacacaaaaacacttgaaagcaactgatcgaaccattaaaaggcagttgttaatatgcatatattgaacaatctgagaaacctgggtcaaaattcaaagagtattgaaaactacagttgtctaccctcattagtttatttttgacaaaaagttgcttttagaaatactttacttgttgaagttgttttactatcaaagcatacctattagcttttgaagggagtcctcctgtaaaatttataggattaaaagttttcatgtgcttgtgactaattatgaggtttatagtggtttacattttgagatagttatatatataatatgcccttttcttttgtgacattatacgtatttttttatattgcatttaaaattaaatgacttgcttttgccagattaaatacagataccattggggttttctgttttgattcctaatgataatatggattgatttcaggtgtaattattgaaacagatataattggttcagaccttttgaagaactctgacccagagacacagtccagcatgcctgatgtaccatatgaaccagatttggatatcgaaatagattttcccagaggtactcaaaacctttatgactatggaatttagttatggagtcaactgtggttatgatcatttaccatttgatgtttgtgtcattgccttttagcagtgttcatattttttattcttgttattttttaaactcaccttaagagttaacttcatattttgttgttgtttttttttaaaaacccaccttaacagttaacttctggaatgagatcacttgagtccaggagttcaagaccagcctgggcaatgtggtgaaacactgtctctactaaaaatataaaaattagccaggcgtggtggtgcatgcctgtaatcccagctactcgggaggctgaggcaggaggattgcttgagcccaggaggtagaggttgcagtgagccgagattgtgctactgcactccagcttgggcagcagagtgagaccctgtctttaaaaaaaaaaaaaaaaaaaaaaattctagaagtaattcattatagaaagtttaaagaagtgtttgtgtcctttttaatttaaaaatgttgttagcatctgggtgcggtggcttatgcctgtaatcccagcactttgggaggccgaggtgggtggatcacctgaggtcaggagtttgagaccagcctggccaacgtcgtgaaaccccgtctctactgaaaatacaaaaattagctgggcgtggtggtgagtgcctgtaatcccagctactggggaggctgaggcagaattgcttgaactcaggaggcggaggttgcagtgagccaagactgcaccattgcactccaacctaggcaacaagagcaaaactctgtctcaaaaaatatatatatataaaaaatatataatatatataatacataaatataattttatatattatatacatcatgatgtatataatatataaatatatacaatatataatataaatataattttatatataatatatattttatatatattatatagtttttatatatataatatatatagttagcttttttttaagatcctttgaaaattaagttcaccttcaaaggaaaaattattttcaggtcttttgtaaaataagtgtgccccatttttcattattttcttaatccatggatggctaatgagcacactgagtagaatgtaaaacattagtttttggaaaaaacatttaatagattgaatcagatttgtaccaagaccatttagatcttgtaattggatttcagactataataatttttctggtatcatacattttcatgaaaattttatgttgatattcattttatatatgtttttaggagtttgaacagtgtttgtcagaattcacaaaccatgttaggtacaatgagtcatttactccccagcccagcctagattgtccccatgtatgaatgctggtttacatcctgtggttagttctttgttggctgtgtttatgtaaccctgtgctatttcatttaaaataaaagttctgatttggttgtcagctgctgaggagcttgatatggaaaatgaatttttattaccacctgtttttggcgaagaatatgaggaacagcccagacctcgatctaaaaaaaaggtacattcacttaatagcctatataacaatatttctctataggcaaacaaggatacagtgttcttttagtgtgcctgagaatatgggaacatattttgttttctaggttggaaaataatttattttctatttatatagaatatagtaataatatattactgctatttattactactatttattactatttctatttgtatagaaatagtaattattactatttctagtaataatagtagtaataatttatttctagtaataatttattactgtttctaagtaataaaaatatctcagatttagttgatacctcaactaaacttgtattgatacaaggtcaaaatagaaaacagttgctaaagtagtaagttcaattatttgacaaaaatttagactgttttctagggagctgttttttccacgattatttctgatgagatgatcagtggggttgaagtacacagtttattatttctggtctcttttaggcataccaacacacatagaaagacatgctggacagtttgatcattcaggtagaccaaatctacatgcattaacaagtgtaattgttataatattctgtcaactttctgtgtttctgacttccaacataaagcaggttttaaaaataccttaagaaagatagctttcacaaattgtccccaaaagaaagaaaaaaaaccggaaaagggagagaatacttggagtggaatgaaggtggacttctgcttgacaccaaacacaacaattaactcaaaatgagccatagacctaaatgtaagagctaacaatataaaactcttagaagaaaacataggcctaaatcttaatggccttatgttaggcagtttcttaggtaagataccaaacgcacagggaagaaaaggaaaaataaataaataaactggactacatcaaaattaaaaacttttgcattgcaaacagtgccatcaggaaagtgaaaagggggccaggcacagtggcacctgtaatcccagcacttacagcactcaggaaggctgaggcgggaagattggtggagcccaagagtttgagaccagcctgggcaacatagtgagacctctacaaaaactaaaaaataaaaaccagccaggcatggtggcacgtgcctgcagtcccagctacccaggaggaggatcgaggctgcagtgagctatgatcgtgccactgcactccagcttgggcaacagagcaagacctctcctcaaaacagaactccagcatggatacttacctggcaggggagataccgtgattacaaaactctagcatgggtgacagagcaaggccctgtcttaaaaaaacaaaaataaaacaataaaataaaaaagtgaaaagtacttaagtgtcactctctataaggtggagttgttgaaaagttcttcagtttctgttacagtaatatttagattattagtttattgtcttatatttattttctcatcattggtgactctcaccacagaatttaatatgattttgttgcacaaagtgatttatgtagaaacatcacatttcctggaatattaattgactgttgtcagattcaggaataccagtcagttcaaagcaaatacctatatttcattttttcttttctaatttcatgacacattaaacaaataactatatttttatgacagattaaacagataactatatttgtaattacagatgaccgttgtacaatgcagtggttgggctctgatcccccctgcacagtcacaaatttgtgtataacttttgactccctaaaaagttaagtactagtagcctactcttcactgagcccccctgcacagtcaaaaattcatgtattacttttgactccctaaaaagctaactactagtagcctactgttgactggaagccttgctgataacagttgattaacacatattttatatgctacatactgtatttttataataaagttagctagagaaaatgttatcaagagaatcatatgggagagaaaatatatttacgattcattaggtggaaatagatcatcctcattgtcttcaagttgagtaggctgaggaggaagaggagagaggttgatcttgctgtctcaggtggcacgattggaagaggtagaaggaggttggagaggcaggcacacagaaaaacatacgtgtccaagtggacccctgcagttcaaacccatgttgctcaagggtcaattgtaatttgcctttgttgagagatggcttgtataaagtaatgaaataatgtaggctttaaaaaagatattattatggtgttttttactaatagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttgtaagtgttttaattttgtttctcctaagtcctatttaaaatcaagatttctgttattgagtacctttaaatttaaaaaacataaatgtaacttaaaatacctgtaagaatgcattttattttacttcagagctcttacaaagaataacgtcagaaagtttcttaaccttaataagacgctaaataataacaattattttttattttatgtatttttagctaaatcagtaaagttaaaagaggatctactctctcacaccacagctgagcttaactatgggttagctcattttgtcaatgagatccgacggccaaatggagagaattatgcacctgacagcatctattacctttgccttggaatacaggaggttagtaatttgatggctgctttcaagtataacattaataagaaaagttgtggtagttcttgtttctgtagcattatggaacctttattgacttaccaagaaacacatctacaaagttgtatgtttgctgccatttatatataaatgataatcaggatgacattctttccttacccattgcagataagtgaattcacattataaggcatgatatgtagccacatctggctatagatccatgctgatctacatgtaaacagaaaaatgtcataactctgtaaataggtctgtttcactgtatgcttctgatgtgtttctaacttgttaaatagtataactactcattaattctttggctatttcataaaaagagatcattctttaggggtaaagataaacttcatccacatgtctatgaatttgttttctacagtaaacatggagatcaactttaaataatgacctctagttctgaacagattccacagatttgtgcccagaagtcagaaagaatctccaacttgacattctatgtattttgaaatatggtagatgacaggggagatctcttcagagttttgtttgtaggcctaaaaattcattttattctgctaacaggtgttagataatgaagtaaatcactgaagaaaactagaattgtcttaatttgtgttttttttactttttctttaggatagaaatttgcttaagattctgtaagtggtggtgcagatatatagtgcatggctataaatcactgtattcaaggaccatcatatatcttgcagtagcaacctaaaagatacgtgaataggtttacttttttcttattctcgttttataggtttacatgtactttgagcctcatgcttagatgataatataggtccaccattccacaaacctctgaaaagcagaatttttttcatgaaaacacagtaaacagtaaaacctaactt

SEQ ID NO: 6278 - DNA, 9718 bp, Homo sapiens
caaagcagttctttgcaaacctttaacaatgacaaaagctacttactgtaaacctcacatgcagaccaaatcttgtcagacaggtaacttaggacaatgtgacttacatacttccccataccttcatctcacctaatgaaatacatgcttttcttgaatgacacctccaggatagattcatttggtcaatttgtcattttctgttgattttgcttacgtaattttagatattacctggagaatacagcatctcattttaaatcattatgatcaatctctgataaaggcctagaatacaaattatgtcaaaagtgaaaaaatactatctcgaaaatttccttggggataagactactaaaattataatgcttcctctgagaaaatcatctctttgcatgtggtttgtaatggtaacagttctgtttccttcctgtcagaatgaggtgaaattgttcaaatatgtattttttatgaaatttacagtgttacctgtgtattctaattatttgattaaataagcctttggggaggttgttgaggagagtatggtagggtatctggaactacatagtgtttttaaaggatgttttctttcttaaaaaaaaaaaatccctaaattctatttgtattttctgtaagttagaacagctgctgctttcttttttgtcctgttctttttaagttacctaacttaaaaaaactgggaattaaaaaaaaaaaaggtactgaggtagttaaatttttctttatcaaattattttaacattgagcacctgtatataagtgttagttaacattgctccttaaatatgttttgtgtttttagatgatacttggaggacagaatatgttccagtgcctatccctgtgcctgtgtatatcccagttcctatgcacatgtacagtcagaatattcctgttcctactacagttcctgttcctgtaagtcacattttaagttctttctcattttgagatttagcagacacagttgggaaaacagtgtacagttgacccttgaacaacaagagtttgaactccatgcatccacatatgtggatgattttttttttttcccaataaatatgggcggccctctatattggcaggttccacatccgtgaccaaacacagactgaaaatacagtattctgcctgtaatcccagcactttgggaggctaaggtaggcgtatcttcagcccaggagttcaagaccagcctgggcaacatggtgacaccctgtctctactaaaaatgtaaaaattagccaggcacagtggcatatacctgtaatcccagctacttgggaggctgaggtaggaagattgcttgagcttgggagatggaggctgcaatgagccgtgattgcaccactgcactgcagcctggtctacaaagcaagtccttatctcaaaaaaaatgaaaataaaaaattatttgaggatgtgaaatctgtgtagaaggctgactgtaggggtgtggaacttgagtatgcatagactttggtatccatccacaggtggtcctggaaccaatcccctagaatactgaggataactctagttgcagttactagtttaatgaagctaataaaaccatctttacctttcttcgacagttaacttagatttggttgaatctctgttgtcatgattgattgctttgtgtatagtatgtatatgttcatcctcgaggagtgactttcgcggatgtctgtgcctgctctgtgcatattaagtttatatttgggttcattttcaaaaggaatatttgtgggccatgtgcagtggctcacgcctgtaatcccagcactttaggaggctgacatgggcagatcacctgaggtcaggagttcaagaccagactggccaacatggtgaaaccccctctctactaaaaatacaaaattagttgggcatggtggcacatgcctgtaagcccagctgctggggaggctgaggcaggagaatcgcttgaacccgggaggcggaggttgcagtgaactgagatagcgccattgcactccagcctgggcaacaagagtgaaattccatctcaaaaaaaaaaaagaaaaatatttgtgaagccataaggtttagaactgaaacatagaatttcatataaaatattattttatcccaaatcacttgcagtacttagaagaacactgtgtcagggcttggctattatagtcccctgggggacagaaatacttcaaaaattctttttctttaatttgaattccaaaaagtagatgcttgtattctaggctttcttatcacagttaacatcttagttttgtatgtgttcttttcaaagcttttatccagtgtgatattacaaagtagatcatgtgtcagagtaatttttaatttggaaaaataccttttaatgtttagtaaacctaactcaaaatgatttggttaattaggtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgagctacactaaattataccttgcgaataagtgttaacattggttatttataagtattgttacagtactttccagggcatatcattttgtttcaacttatgtgggggtgaggaaagcattgtaacaaaaatgttttttatattaagagatctacactgtatttagccaggtgccctcagacagatatccgaagcaggaatttggtctttggtctctgttttaagcaggatttgacttgtaaaatcaactcaaaattattcttgttaatggagtagtgctgatgcaaaactataataacttgtagtagactctaatgatgatcaaaactcttattttgtaatagttatccctagttttttgttttgttttgtttttttttttagatgaactcttgctctgttgcccagggtggagtgtagtagcatgatcccggttcactgagatctctgcctcctgggttcaagctatgcttctgcctcagcctcctgagtagctggaattacaggcacgtgccaccacgcccagccaatttttgtctttttagtagagacagggcttccctatgttggccaggctgatctcaaactcctgacctcaggtgatccacctgcttcccaaagtgctggtattacaggtgtgagctaccacacccagcccctagttttcttttattgcttatactaataaaataatttgcattatctaaaccagagtttatcttaacctctgttagggcagtgcttgcgctacatggtataatgtgatgagtgtgttgtggatggttctaagtcacttagaatatttattttccacccttaaccctctcttgatacccaaagtcctatttcaaccttgagctaattcttacccttaccctagaggacaatcaaaatactataattttctctggatttaataatgagacagtgtttttgaagcactgtggtaaggagttgtgaaattagtgggttgcaaccagtgtttttgtttaagaaaagaaaaagctaagtggaatagggtaagagaaatgacagtgtgaatccctcatagaaagggtaagtattattttgtgaaaccagtgtgtatacagatgtctttctgttccccaccatcaccttgcagtatgtgctggataaaatgcatttcttgccatgattacaacacaaaaacacttgaaagcaactgatcgaaccattaaaaggcagttgttaatatgcatatattgaacaatctgagaaacctgggtcaaaattcaaagagtattgaaaactacagttgtctaccctcattagtttatttttgacaaaaagttgcttttagaaatactttacttgttgaagttgttttactatcaaagcatacctattagcttttgaagggagtcctcctgtaaaatttataggattaaaagttttcatgtgcttgtgactaattatgaggtttatagtggtttacattttgagatagttatatatataatatgcccttttcttttgtgacattatacgtatttttttatattgcatttaaaattaaatgacttgcttttgccagattaaatacagataccattggggttttctgttttgattcctaatgataatatggattgatttcaggtgtaattattgaaacagatataattggttcagaccttttgaagaactctgacccagagacacagtccagcatgcctgatgtaccatatgaaccagatttggatatcgaaatagattttcccagaggtactcaaaacctttatgactatggaatttagttatggagtcaactgtggttatgatcatttaccatttgatgtttgtgtcattgccttttagcagtgttcatattttttattcttgttattttttaaactcaccttaagagttaacttcatattttgttgttgtttttttttaaaaacccaccttaacagttaacttctggaatgagatcacttgagtccaggagttcaagaccagcctgggcaatgtggtgaaacactgtctctactaaaaatataaaaattagccaggcgtggtggtgcatgcctgtaatcccagctactcgggaggctgaggcaggaggattgcttgagcccaggaggtagaggttgcagtgagccgagattgtgctactgcactccagcttgggcagcagagtgagaccctgtctttaaaaaaaaaaaattctagaagtaattcattatagaaagtttaaagaagtgtttgtgtcctttttaatttaaaaatgttgttagcatctgggtgcggtggcttatgcctgtaatcccagcactttgggaggccgaggtgggtggatcacctgaggtcaggagtttgagaccagcctggccaacgtggtgaaaccccgtctctactgaaaatacaaaaattagctgggcgtggtggtgagtgcctgtaatcccagctactggggaggctgaggcagaattgcttgaactcaggaggcggaggttgcagtgagccaagactgcaccattgcactccaacctaggcaacaagagcaaaactctgtctcaaaaaatatatatatataaaaaatatataatatatataatacataaatataattttatatataatatacatcatgatgtatataatatataaatatatacaatatataatataaatataattttatatataatatatattttatatatattatatagtttttatatatataatatatatagttagcttttttttaagatcctttgaaaattaagttcaccttcaaaggaaaaattattttcaggtcttttgtaaaataagtgtgccccatttttcattattttcttaatccatggatggctaatgagcacactgagtagaacgtaaaacattagtttttggaaaaaacatttaatagattgaatcagatttgtaccaagaccatttagatcttgtaattggatttcagactataataatttttctggtatcatacattttcatgaaaattttatgttgatattcattttatatatgtttttaggagtttgaacagtgtttgtcagaattcacaaaccatgttaggtacaatgagtcatttactccccagcccagcctagattgtccccatgcatgaatgctggtttacatcctgtggttagttctttgttggctgtgtttatgtaaccctgtgctatttcatttaaaataaaagttctgatttggttgtcagctgctgaggagcttgatatggaaaatgaatttttattaccacctgtttttggcgaagaatatgaggaacagcccagacctcgatctaaaaaaaaggtacattcacttaatagcctatataacaatatttctctataggcaaacaaggatacagtgttcttttagtgtgcctgagaatatgggaacatattttgttttctaggttggaaaataatttattttctatttatatagaatatagtaataatatattactgctatttattactactatttattactatttctatttgtatagaaatagtaattattactatttctagtaataatagtagtaataatttatttctagtaataatttattactgtttctaagtaataaaaatatctcagatttagttgatacctcaactaaacttgtattgatacaaggtcaaaatagaaaacagttgctaaagtagtaagttcaattatttgacaaaaatttagactgttttctagggagctgttttttccacgattatttctgatgagatgatcagtggggttgaagtacacagtttattatttctggtctcttttaggcataccaacacacatagaaagacatgctggacagtttgatcattcaggtagaccaaatctacatgcattaacaagtgtaattgttataatattctgtcaactttctgtgtttctgacttccaacataaagcaggttttaaaaataccttaagaaagatagctttcacaaattgtccccaaaagaaagaaaaaaaaccggaaaagggagagaatacttggagtggaatgaaggtggacttctgcttgacaccaaacacaacaattaactcaaaatgagccatagacctaaatgtaagagctaacaatataaaactcttagaagaaaacataggcctaaatcttaatggccttatgttaggcagtttcttaggtaagataccaaacgcacagggaagaaaaggaaaaataaataaataaactggactacatcaaaattaaaaacttttgcattgcaaacagtgccatcaggaaagtgaaaagggggccaggcacagtggcacctgtaatcccagcacttacagcactcaggaaggctgaggcgggaagattggtggagcccaagagtttgagaccagcctgggcaacatagtgagacctctacaaaaactaaaaaataaaaaccagccaggcatggtggcacgtgcctgcagtcccagctacccaggaggaggatcgaggctgcagtgagctatgatcgtgccactgcactccagcttgggcaacagagcaagacctctcctcaaaacagaactccagcatggatacttacctggcaggggagataccgtgattacaaaactctagcatgggtgacagagcaaggccctgtcttaaaaaaacaaaaataaaacaataaaataaaaaagtgaaaagtacttaagtgtcactctctataaggtggagttgttgaaaagttcttcagtttctgttacagtaatatttagattattagtttattgtcttatatttattttctcatcattggtgactctcaccacagaatttaatatgattttgttgcacaaagtgatttatgtagaaacatcacatttcctggaatattaattgactgttgtcagattcaggaataccagtcagttcaaagcaaatacctatatttcattttttcttttctaatttcatgacacattaaacaaataactatatttttatgacagattaaacagataactatatttgtaattacagatgaccgttgtacaatgcagtggttgggctctgatcccccctgcacagtcacaaatttgtgtataacttttgactccctaaaaagttaagtactagtagcctactcttcactgagcccccctgcacagtcaaaaattcatgtattacttttgactccctaaaaagctaactactagtagcctactgttgactggaagccttgctgataacagttgattaacacatattttatatgctacatactgtatttttataataaagttagctagagaaaatgttatcaagagaatcatatgggagagaaaatatatttacgattcattaggtggaaatagatcatcctcattgtcttcaagttgagtaggctgaggaggaagaggagagaggttgatcttgctgtctcaggtggcacgattggaagaggtagaaggaggttggagaggcaggcacacagaaaaacatacgtgtccaagtggacccctgcagttcaaacccatgttgctcaagggtcaattgtaatttgcctttgttgagagatggcttgtataaagtaatgaaataatgtaggctttaaaaaagatattattatggtgttttttactaatagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttgtaagtgttttaattttgtttctcctaagtcctatttaaaatcaagatttctgttattgagtacctttaaatttaaaaaacataaatgtaacttaaaatacctgtaagaatgcattttattttacttcagagctcttacaaagaataacgtcagaaagtttcttaaccttaataagacgctaaataataacaattattttttattttatgtatttttagctaaatcagtaaagttaaaagaggatctactctctcacaccacagctgagcttaactatgggttagctcattttgtcaatgagatccgacggccaaatggagagaattatgcacctgacagcatctattacctttgccttggaatacaggaggttagtaatttgatggctgctttcaagtataacattaataagaaaagttgtggtagttcttgtttctgtagcattatggaacctttattgacttaccaagaaacacatctacaaagttgtatgtttgctgccatttatatataaatgataatcaggatgacattctttccttacccattgcagataagtgaattcacattataaggcatgatatgtagccacatctggctatagatccatgctgatctacatgtaaacagaaaaatgtcataactctgtaaataggtctgtttcactgtatgcttctgatgtgtttctaacttgttaaatagtataactactcattaattctttggctatttcataaaaagagatcattctttaggggtaaagataaacttcatccacatgtctatgaatttgttttctacagtaaacatggagatcaactttaaataatgacctctagttctgaacagattccacagatttgtgcccagaagtcagaaagaatctccaacttgacattctatgtattttgaaatatggtagatgacaggggagatctcttcagagttttgtttgtaggcctaaaaattcattttattctgctaacaggtgttagataatgaagtaaatcactgaagaaaactagaattgtcttaatttgtgttttttttactttttctttaggatagaaatttgcttaagattctgtaagtggtggtgcagatatatagtgcatggctataaatcactgtattcaaggaccatcatatatcttgcagtagcaacctaaaagatacgtgaataggtttacttttttcttattctcgttttataggtttacatgtactttgagcctcatgcttagatgataatataggtccaccattccacaaacctctgaaaagcagaatttttttcatgaaaacacagtaaacagtaaaacctaactt

SEQ ID NO: 6279 - DNA, 542 bp, Homo sapiens
gaaaacattgcgaccagaggctcacaggaacctaatcttgtatttcccattgcagcagtggttcagtagtcattgtttggggcaaccgtatagaacataactattccgaattatgtacctacattttctccgtatcaatagatgatgtggagagtaccttatttttactcccttacgctcatatcttccacttatttcagattttatttatgtggggttttgtcttgtttgcaatgcaaataatgctgcagtgaacttagtgtgaaatatctgagagactgcatctgtagaataggtttcagaaattgccattgctgggccgcaggaaatacacaacttaaagtttgaggatatctttggtaattgttttcatttttcttttcaaatttataatcatatttaaagccatttatccagcagagggagtgagagtatcagagagccataataactgttggatcttctttttctgaaataaatttaaaagtacccaagtattttcatagttcaggtttgcaaccttgattttgtacttaaaagtt

SEQ ID NO: 6280 - DNA, 542 bp, Homo sapiens; identical to SEQ ID NO: 6279

SEQ ID NO: 6281 - DNA, 2845 bp, Homo sapiens
tttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 6282 - DNA, 2395 bp, Homo sapiens
gtgaatttgtggaagcaatctgcattcataactttgattggagaataaatggtatacatggtgctgtctttggaaaaggtaattatcagaattccaggtccaatttgagccccaggagagagtttcctctttttagaggaatataaatataaatatgaactgctttatggcaaatatatagagaatgataaaacaaatggattataattgcattgtgtacgagaatagatactagtgtttttgttttattttgtttttaagaaaatcataggtaagaatattagtgagcaataaggaatagtgggggaaaacttcacgttatttataatgttgtgaaaatccaagtttttcaatttatgtctggtactcaggcaaattaaggagagaggtgaggggaaaaggtatgggatgtacatttaattttctggtccttactttgtaccttgcttccagcaagagaactgactactgtttaggatcaggatatgctgcattttgaaaatgtaaattaatttaaaaaataactactaaaaaggccattccacttatttaactgtaaggaggtcagaaggtgttacataaatcccatcagtgttaggtaaatatgagactttgcaattcatttccacatttttttagagtaagaatgcccttaatgatgtctatctcttgtgtctaccatttcagaagagttggctgctttatcgagttttcatgtgtaggcagtgagccagtaaaatcatttttgttttggaatgctcagatatgaatagcattatactctctcagaaatcttttcatggatatgggattctattgtttccagaaatattactgaattgttatcccatatcatagaaatacggtttcttggggtttaaaagaatccctgtaggccatcggtttccactgtgctctctagagctttgctggatgttgacaagggaacagggtgaggaagtggtgaaaggaaatagaaacgggagggagggccaagcagtaaaactcagggccgggcatggtggctcacgcctgtaatcccagcagtttgggaggtcgaggcaggtggatcacctgaggtcaagagttcaagatcagcctggccaacatggtgaaaccctgtctctactaaaaaaatataaaaattagttgggtgtggtggcacgcgcctgtaatcccagctactcaggaggctgagggaggagaatcgcttgaacctgggaggcggaggttgcagtgagctgagatcgcgccactgcactccagcttgggagacagagcaagactctgtctcaaaaaaacagaacaaaacaaaactcaggtccaaccacacttttaatcattaaaccagttttatctgttttattaattgttttctttgtaagatttattttaaaaacagaagtctgatagctatattttggtgggggcaggggatggtgttggtggtgaggactggtctgtaccaacaaatctattcctatggcagtctatactacagctgtccataacagatggatttctattcttctcttaaagatctgcagatgaggaaattccacatctatttttattatacaattctatgcatctattctcctgacaaaatgtttttgcttgtttttaatatattcttcggagtaatcttggcttttcttggtcctctttgtttaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtcccttt

SEQ ID NO: 6283 - DNA, 6713 bp, Homo sapiens
tagacagtgtctccttccttgaagatgctatcctctgaaataactgtgagtacagtcgcataaccctaatttaagatgtgcctgctgaacatgtgctctctcagatcctgtcctcagaatgcttttggctcttttctcggtatctcatccttagagtttttattttataccaatgttctggattacatacctggtccagaaatctagacttgtacttctttttaattgcctagttgacatttcaaccttgattaaagattgacaatatttatcaccttttcctcctggaacaatttaggttaatggtgcagccttttttcctagtcaaacatgccaggaagttcagggcaaagttcaactgctccctcttgtcttatgtggtcactgcttctgagaacatccaggaagttctttctatacttgaatcatcttctcagtcctttggggctttactgctatgagtatgaacttttgtgattatttatttcagtcttcatgatggtgctatcacattctacagttgtttatgtctgtacccagtaagctcttttgagggaaggaatcttgtcttctcctattcccagtcttgctcatgcataacagatgcccattcctcctaaatatgaatgctgtattataggcattagtaataatccctgttacattgcagtctgaagtatgttttaaacatacttttttaaagttagaactgacttacaagtgaatctattcttagattcttagatactaactactttagatatttagttatactcaataactaaatatcaatactcaatatctgtttcttctgaatttcagagtagttagaatgtttttcttaagactttgctagaaaggaactggtttgttagtaattctgccatcaactcatggagttataattgccaaatgagttaatttttatataccttaagctatcttgcctacaaaaagtaaaataaggcaggattcataaatgttacttgtaaattgagtgtttcacatgaggccaagtatgattttaacataatgaatatcattgctcctcatctgtaaatttgctgctgctttcatatgtgtatctgtacatagagttatgaatgaaaatccagtaatgccctaaagcaactttcttccatagggtcaaagctcacttaaggtaaacgtgtgaaaaaagtgactgcagtgtgtttgaaaccacaagctgtttctatgtcataaattaacatcagcttgcaagtctctgaaagaaccactcatttgtaattggtatatatgtcacaacctcccacattcctttagcccatctcagggaattattgaaacgctggcagggttagtttcattttgttttggtttttttgggtttttttgtttgtttgaggattttttttttcttttatcatttgtttgctcctgtgtaagcttaatatataatggcagtttggcatctgttcttcgcacatgtctaacccagcagagttatgcaaaaatgatgacttcattttaggtcaaattggctttgttcccagtcctcattgttggtcactttgttcagttctggtgactcattggtgatgttgatgaaactgctcagcctgccagctgggatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccatttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttgtctaccataagatttttctgttctaacactttatataaatagagtcacgcaacatgtacgctcttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaatgagtcaatatcaacacttgacattcctgtctttttaatacattttattcttttgtttagaaaattt

SEQ ID NO: 6284 - DNA, 15914 bp, Homo sapiens
aaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatgtaagtgtctattctgattcttttcttttcttcaaattatctgaacacttacctacacgtaatttttttcaggtttgcatgcctcctaaattatttttctgaaccaataaaatgaattactggtgggggtaatgagataaaattctttgattttttttaaaaacaagtattttttaagtcattctgcatgcaattcaaccttttattgtctaactagagtgttccaatctagtagaatattttattttgactccttctcaatgtttatgctttataacttagatggaaatggaagtctcaatacttttttgcattctgctgacctgaatgtacttctttgtcttcctggtgcatgcatctgtgtgttctgtcttccagataatgcatattctaatgattcgtccttgtcttgtaacagtgtagtcttttcaagtgtaattgtgataacctcattagatataaacctcattaatcattaaacactttagatgctgattacatcagggttatctctttggtgtccctctgctttagttgtctcagcagttggatggcttattagggatgttgtgcgtagatgtagcaccagctgatggagcatcgattcagcaaactttaaaactgcttgaagagaagctgaaaagtgttggtaagcagattttaaaaatgctgaaacataaggtttttttttttttaaatatcattaccatggttagacaattaagtcaacttacactgaactaattagtattattttcaggaaacagaaaaatagtataaaaagattttattcccttgaggggttataatttatgctgaaaattttatttttcatcgttagttagtcactcctcccttcactgggcctttacccttgcctgtttacccagctatatctacaggtgctgtgtcttgcatatactatgaacaattatttgtagtgcatgcatgaactgtaattagctgtgaaatgttctgtggtaaatcctgtatgcccaaaattgtgttttatgcaatgatttttgttgttgctttatcctaaccttgtgaaaaaatagttggtttggttttttggttcttgtctcaccaaactgggaatattgtcagattacccattctccaaggagtggggtacatttacattaaggggtccagttacattaagctgatgtaggcttgatgtcatttgacatcaaggcctttagaatttttctacagcaggaagcacagtgaactttcctaaaaggtcaggatgtgacaatgggaaggtggggagtcgtatcaaggggggacaaaaggggaaatggcaatggaagagaggaaacaggaacttaaggcagagaactagtaaaaagtggttgcacatgactaaaccaaattattgaaaactgccttagggaattggtttgaaaaatcacacttgtactgacattttacttgcttacagcctttgttattttatttttttgagatggagtcttgctgtgttgcccaggctggagtgcagtggtgccatcttggctcactgcaacctctgcctccccgattcaagtgattctcctgcctcagcttcctaagtagctgggattacaggcacctgccaccacgcccggctaatttttgtattggtagttatagtagacatggggttttgccatgttggccaggctggtctcgagctcctgacctctggtgatctgcccacctcagcctcccaaagtgctgggattacaggcatgagccagcgcacctggccagcctctgttattttaacagatggtatgcataatacatatttagtgtttaatatgacaaatgaattttcttttaaaatattagttttcttgagccacagtctttgtttaaaaaaaaaaagttcctttacacatgtaatttggagaattgtaaatataccctaattgttgcttcctatggtatagaagctagactgtatctttagtcacaatgttcaacatcctttgacattgatgatacattgctggagtgtcttaaaattttgcaaggcttatgcgcttttttaaacaacatgtttgccttgttctcctataagttggacagcataaaagcaggaagaaaaaacagaaaattgttttctattagaaataggaattttcatatttttcttctgctttcattttttaaaagtaattattgtctatggaaacccatgttttcaaaattccctttagggagaatttggcatgagagagagctccaattcgagttacatttaaagggttttattgcttgaaatgttcataggatggagtcttgggattccatcccaaggtggtttactgtacaaagctcctatacttgggatccaggtacaatatctgatgagacgatttgtttgagggagggaaagcgccttagttgtgtaagagattaaatctagtaacttttgttttagatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaaggcaaagtttgaccgttaattactttttactaaaataataacaatattagttaaaatgaagttatataacattttatatacagacaaaacgttcttaactgttatatagaagacatgtagtaggtttttggtgaatgtgataattactgtatataattttactaacatagtaataatttattcaattattaggtaccattttcctttttattgggttgtaaaaatttcaattatactcaactatttcaaattccatatccccagtgtagtctatgactcttctgctttaaaaaaaacttactgaagaataattttgctttttaaatttcatttagtttagagttgccattaaacttgtcatctacattgatctgtttcttcatctaaacttacagaatgtcacacattcattgttctcatatttgctgtaggaggattaaacagtggactagtgatgtttagtttcattttctataaaactaggaattcaaaagattctttgaaaactcagtttgcaatagcaactacaaagtattgcaaagtaaaggattaaaattatgcaatatacacaatctagcatggttatatgaaattttgcacacttaaaaattttatgatcatcaacaaaacttcacagaaagcttccttctgcatcacagagaaaacagtcatgaggcagaaatttcttccctcatatctgcaaacttacttttattctgtcaccacagaggatgatagagctctccgtttatatcaaaaaatatcaaagctgagcttccatttaggctctgattctgatcaccctcctgactcctaactccatcaaatcccattctctactctggttcctgccctcacttaaatgcttaaatttctcctgttttaaaaataataatcacacatatgggtacgtcttcctcttcaactctttgtcttttagcattagaactcttcctcacagctaagtcatttggataggtttacggtacattcatactacttcccccactacctccaatttattttcaactcttttcagtctgacttctaccctaactatttcattcagtgttgctcttaccagcattaccaacgtaataaatgctgtatcttacttaaagttcagagaatacttttagtcttgacttgcttaactgtgattagcgttaggcacaactgacttttcgatttcatctttcttgaaaacacatttatgatccttctctgtttcttcttggtttttgtcactgatttcttggccactagctaaagttactgcttccagggtttgttctgaggccagattcccttctttatatattctccctggacattctcactacttgaattactttctttaatagatcatggtttagtagttacagctctcccgtgctgtagacccataattccaattgcctacttagtgtcgcctgcgggatgccccatgtactgctgaaatctagtgtattagtccattcttgcattgctataaaaaactacctgagactgggtaatttttcttttcttttcttttttttttgaaacagagtctcgctctgtcactaggctggagtgcagtggtatgatcaaggctcactgcaacatccacctcctgggttcaagcgattcttctgcctcagccttccgagtagctgggactataggcgggtgccactgcacccggctaatttttgtatttttagtagagacggtgtttcaccatgtcagccaggctggtttcaaactcctgacctcgtgatccgcccactttggcttcccaaggtgctgggatcacaggcgtgagccaccgcacccggccgagactgggtaatttttaaagaaaagaggcttaatgggctcacagtcccacaggctgtacaggaagtatggctggggaaacctcaggaaacttccactcatgatggaaggtgaaggggaaacagacacatcttacttggatggagaaagaggaaaagagtgaagggggaggtgcggcacacttttaaacaaccagatctcatgagaactcacttactgacatgaaaacagcaagggggatatgtgcccccatgatccagtcatctcccaccaggccccttgtatttattagtccattctcacgctgctatacctaagacaggataatttataaaggaaagaagtttaattgactcacagctttgcagggctggagaggcctcaggaaacagaatcgtggtggaaggggaggcatctaatcacatcccaccaggctcctcctccaatattgggattacactttgatgttagatttaagtggggacacaaatccaaaacccagatccaaaccagatcacctagtatgtccagactggaatcattttcctctaaaacttgctctccttttttaatttcctgcctaggttaaagttaccatcagctaccaaacttgagatttatcctaaaatccttcatctttctcatcccttatagcttaatcaaatgtccaggttctgctgtctctgaatctcaaacatttatggtcaagatcttaaactcttatctgcctctggcctggctactctccagctttttgtatataagtgtaattttcataaagtacaacaattgtgtaaaacttccttcagtgacttcctgtttgctcagatggagtttgtcttcttggaataatgtaggagacccttcataatccaattcttgcataattttatcttctataacattcccataaaatcacacagttgtttttatctccctgaaagcatcatgctgtttcatgcatccatgactaagaatacttgtttccttgttttctgctcagtgaattcctacttactcttcaagactcagggatacttactttactttaggaagcctttttggacttctaaggcaagttagtcacttgctcctccctactctcataaaacattttaaatagctttataatagtacttataacatctctgcaaatgggagcatcttgatagtagagaccatatcttatattttccccagcacacattatctaatacctgaatacagtatatgtatgataccatcttcatcaaagtggcctacattgttttttagtttcatatttaaaaaataattatcacttcccttcagtccattgtagaattactttaaccaagttgaattttaatgtcatgttatagcttttattcagagcatctttatttttttttaaaaaaaagccttgtgatacctacttctatattgttattaagctttctttaaggacatcaagtatagtagagcacagtgtctggtaacatattatcggtatttgagactgcagtgggagtcccccatcccacctgcagtacgcagaatttcatggaaatgaaggaaatggaccagagttaagttaggttaagttgccttaaaaatttaaatggttatattatccaaaaagaccacaatgagattaaaaaaataatttgaattgtgtttctctacacccagaggtcagtagagtttttttgtttttttaagccctccatctagtttttaagaatgtagatggagggttttaaaaaaaatcagaattaaatattattttaggtactataatataatgaaaagcgttaatgtttaaatgtttctttagctgggcatagtgatgcacacctgtagtcttagctacttgggaggctgggatgtgaagatcatttaagcccaggagtttgaggttatagtgagctatgatggtaccactgcactccagcctaggtgcttgagtgagaccttgtctcaaaaaaatatcatcctgtatttgagaaacattacacttttatccttgaaacttgtttgatgctaaacagcaatggagattttttttgggttttagtgtactattgtccttacattttgctttaatattttgcagaatccatgctatctttaagagggtttgtcattgagtatcatttgggtattttgatgttttgatgtaacattgatataaatatccctaaaattcttacaaatcaatacaaaatacttgcattctccattgtttaggactaagtattttagtgtactataaaatacatgtaccaaatgatgatgttacaatagtaatcaataaaacagaaatgatgagttaaatttatgtttgggttcattagatgtgaagacatggtagatgtgcgaaggttaaagatgcttcagatggtgcagttgtttaaatgtgaagaagatgctgcccaggtaaggagcagtcagctacattatgtagttaacttttcttagaagattgattttatctaactacaaacaaaagtgtacttttcatggtcctaaaaaagtaaattcttgaagtcaggttctagtttatctatcttgttgaagaatacactttggtattcccagctagttgattgatctcatttaacttaattttctcaatgaaatcctctataatcctctattgagctagagattgggatcgtttattatttattattgttgattaggttgtcagttacatccaggataaaatctggtggagcacactgcattttgctctcttgcatctgcaagagaaatttcaataccagataaacaatttgatatattttgtcgttatcatcagagaacatcatttcagttagatatagataaaatttttgattttatgtagtaacacaaatctgtaatgcaatcctgatggatctacatacagaaatacatgatcttttattatgtgatattaattttaaaagaatgcttttcttcagtatgtcttgccttcagatttaaagaattttgaggagtaggacaggtcattaattcatgtagcttatcattgaatgaaataagcttttaagactttaggttataattaacggatttattaatcacatgatagtaatctctgtataaatgacattttgatacaataagtaaagagttctgaatccagcttcattgttatgtctttttgtttaggcagtagaatggctaagtgaacttctggatgctctgcttaagactcacatcagattgggcgatgatgctcaagaaacgaaagttttgctggaaaagcatagaaaatttgttgatgttgcacaggtgcaaaactggttatcttccttttccacaagctcagtgtttgaatagctttctgcatgattataatgtaactttaccttccaagtacaagaaggttagttttgttattccagaagtgtcacagaattaagaaaatgtcagctggtgcatcaaaactagcctgcataaacttgagagggtttacgtttccctgaatacatgttctgcatggtccctctgatttatgctatgtattacggcatttttaaggcaatccaactgttcatccacagaagttaatatgaaatggatgttaatatcagtaaataagaaacctcactttctgcatcacactagtgttagcataataatacagaacttttttgtggtgaaaagtgtctttttttttttttttaagacacagtcttcctctgttgcccaggctggactgcaatgatgcaatctcagctcactgcaacctctgcctcccaggttcaggcgattctcatgcctcagccacctgcgtagctgggattacaggcaccggccaccacgcctggctagtttttgtctttttagtagagatggggtttcaccatgttggccaggctggtcttaaactcctgacctcaagcgatccacccgcctcggcctcccaaagtgctgggattacaggagtgagccaccgcgccaagccaaaaagtatcttattttccctaataatgagttcacgttttaacagatgtagtttcctatatggaatataaagtgcctaatttcacctacttttgaaagtagttttgattaattcataagcagacattctttctggccagtgaaatttaagcagactgcgatgggggaaacagaataaagtggggaagcctaacagaaggagacttttttctaattaaaaattttaaaacaatttttgtttttttgagacaaggccttgctctgtcaattaggatatgatgtttcagcacaatcatagcgcactgcatcctcaaactcctgggctgaagtgatcctcctgcctcagcctccaaggtagctaggactacaggcaagtgtggccaaactcaactaatttttttcatttttttagagataggatcttgctatgttggccaggctggtcttgaactcctaacttcaagcaatccacccacctcagcctcccaaagtgctgggattacaggcatgaatcactgtgcctggccatgaaacttattataaactaacaaaaacatagcttcccctttattacttatacacacagatgatttgtagtaataagtgccactagatttattcagtattgatttctagtagtgtcacttaactgtaacgacaatcttcctgcacactttccccatccttctcttaagaattcttttattacaattttatgtttccttttcttttttagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaaggtttgcttgtgtttttgaaatgttattctcagtggtattgattatatgtgtttaaaatatgttaattttagtaatgtaactatatgactaatctatttttcaatatttatattagttccgttgttacggtttgtttagatataatacattgccttagagagttcaaattaaatttccttaatccttaccagtgctggagagccatgattggagaaatccagaaccacctggtagtcttcttctctttacacttctctcctcaccaagcctggtgtccagaatatgccctctgttctttagagtatcatgagttcaatctctttcgttatgcctggaagggaaactttttgctttggcaactgctattaattgtcacacattttttaaaaggcaccttgtgattttataaagtcgggacattaaaaaaataagaataaggacaaaagtaaaatgcttttttatatgtgttctttaaagattcattctagaatttattattcaatgaattaaggtcattaatttcagaaacaaaaaataaaatatgcagggttatttggacacattttcaatagaacttttttcttactcttcatagtaagaatttattctacccaagccttacatatccattctgaaaaggaactttattatgtagttaattttgttttgatctcttacaataaaagtttatatgtagggaatgttcgatacactttgagatattagcaaacctaacttgatccatggaacagatgttgcaaggaacctcaggaattaaagtttctatctgagttatgaagtacatctgttgggaagggtccatagttaactcattctcagctggtcattgaactccgtagatcagtgtttgattaacatgggcctaatgatgataagtggaagtatacaaaatagtgtaacttgtttatctactgattgtttcaatgagaattttttattattatgaagtatactattaacatagaaaacataccacaagtattctgtgcagtgagatttcataaagtgaacacacctgtgtactcagtgtactgttcaaaaaaaacagaacattaccagcacccagaagctccccccaccctgtgtaatcacagtactgctcccccaatcacctcactgtcaaagggtgacaattggcccaatgtctagcaccactgataacttttttttttttttttgagacagagtctcactctgttgcccaggctggagtgcagtggcatgatctcagctcactgcaggctccacctcctggagcttgttgtacaaacctaagtaaagccctttgttatcagatattactttcctcttgactgtattctattttataccataagcataaatataaataaccacaactataagcaaattgtatagtataatgattagaaaaatatctaaattaaatcttgagttttaaaatacaaaaatgtccgttcatgagtaatgctgaagtaaacatgattagataaagtgtaatgcaaaaaaaagttgtaaaaatgaatactttttattctctctctcaaattttgcagttcttgtggtttaatttaaatggtaatggttagggtggagtgaagaacagtatctcatcaaggactatagagattaccatatttgaattataacctaatcattttatggcagttaactcaagccagcagatcagttgttaaatattatcatctagctgagttgtcacatcagttatttatttgtactctttgttgttttttatttatataatttttcatttgtaatgtctatatgctctttgagaacacagtctatacctccttcaccttccagactgctacataaacataaactgttcaataaatggttacttaatataaatgaaagaatacttcttaaggacagattgaacttattttccaaatagtagtctagttattttctttcttggaaatcaccatattgttagtaggaattatgtatttcattttgtttgtttgaatttcttgaagaattttgccaataatagatcaatcttatatagtggtatacctgaagatgctaagaacaagaaaatgcctttaatctaccaaatttgtatgagcttgattccatttctgtgtctttcttttctctctttttttttgtggggtggggtgatcctctgaaactgcagacctgtctgtgtctcttgattgatgttgctcttttatttgttgcagattttgcaggactgtccagaagagcctgaagctattaatgatgaggagcaatttgatgaaattgaagcagttgggaaatcacttttggatagattaactgttccagtagtttatcctgatgggtatggggcatgttcttataattttattttttattggtgtggtcttaaagtgaaatcattaaaagaggaaatctattctttaaaaagccaagtaaattaggtttggtccacatctttaactcctacgatgaattagtttaaaatgaaaagaaatccacacctcttagccacagtaatggtacttgccaacaacagatgcgttacttcttgacagcttgttgtagaatgatcattgactagattaagacactgggttctagccttggctatgatggtggggaatagtgtgacttggggcttcattcaggaaaaggaagaggggacaagggattgatgtttagtgagttcacaatatatgccaagtaccaagtgaaacatttcaccttcattacttttgaccaaagaggaccaaaccagtatgattattcctgatttacaaatgaagaaactgaggcccacagagattaagtaaggctctcaggatttcacagcttctaagagttagcataaacttacaatctcaggtatgtctgtgtggctccaaacccattccctttgtactgtgttatatggcgttctaatttctttatgtgtgaaggaatggggtcctgattatcttacacctttccatttcaaatagtgataaaaatatgaaataatctgatgcaaaataaatggatcaggaaaagaatcaggaagagcttcagccgggcgtggtggctcacgcctgtaatcccagcagtttgggaggccaaagcgggcggatcacaaggtcaggagatggagaccatcctggctaacacggtgaaaacccatctctactaaaaagacaaaaaattagctgggcgtggtggcgggtgcctgtagtccagctactcgggaggctgaggcaggaaaatggcatgaacctgggaggcggagcttgcagtgagccgagatcacgccactgcgctccagcctgggtgacagagcaagactccgtctcaaaaaaaaaaaaaaaaagaatcaggaggagcttcatccctggtgatttagacctgattcttactgaaaataatttagagataatccagaggatatttaattcaaatgatagagtaaccaaaccagtgaataaaaatacaagtacctttaacgttgtggtatagtgtgatgagtctgtgcactctggagccagaggtctcagctctaccacttactcactgtaacaccttgggcaagccacttaacctttgtgcctcaattccctcatctaaaaactgccatgtaacactcataccttcctcaggttatgggggtgtgggaattacctgagctaaataagtataaagtacttaaaacagatctgacacataataagcactgctactactgtgccatgatcttccagtgattatttgggattgatattgaaaagatggcattttattcccttgaaataatattattcatagtctatacttacgttatctcaagccccacctaaacttgaacaatcagaggtagcctaaagtcacctaaagttgtattacacatctgcaataaaagacaacaaaattcagctagtagcagaattacaggcgtgcttctggttgttccattccaggatcccttaccctccctgattcctacatttcacagccagttgtcacacagtcagtctcctgttctacccatgtcagcctaggaacacctctccctggtatgcttgcttcagcttctcgtctgtgtttcacagatagtccatgtgtcatttcctcatccatccttttaagataaaagaatgttagtactatatattcaaagttcacacccacctttaatattttggaattgctgttttattccactttatattcatattaaaacttatgtatatctcttttaggtattttgctgaattaaatatttcccaaagttgtgtgtagtgttttccataattattaatataatggtaatctgtttatgccatgtatagtttgtttgacaggttagacagatttctcttttataccttctcctggtaaaataaaagagattgatggtctctctggattcactgctcaaagacctaggttcaaattctggtttttccctgggtgaccttgcttacatcatttaacttgctaggctccacttttctgatctgaaaaataaagagattaacctgataatttctaagaaatcttccagctctaaaaatattctgtgattctgaatacagtatctttgagagtagaataaaattaataattttatctgttaatgtaccaaaaaatgtcataacattaaaaagaatatttattttgcttgccagctctatagacaagtggtgtccccagccggtagcactcaagtacctgtataaattttatgtttgtgcatccttctggacccacatatttccagtgtttcattgttcaatttgttgctattatcataactacacatgatataacctttataccatcaatatatttttctcatcatgtcttaatgtattttatgccattttaaaaaatgtttttcctgctgaatttcctgctcaaacagtatgatcaccgatgaactgatatttacacataggctatctcatgtagattttttatggtaaatttttgcttctatttgtattcactgcagttaatagatttgtattaatctgaggtttttctgtgtgttttgatttttagaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattcttaggactgtgaggatggtttaatatttgttttttcatggtggttgcatgtattttagacaggaaatacatatgtaagcatgtgtatataataaataagcatgttttatcatgaaaaattattgtgaacaatttagatctttaagaacttattaataatggaatactatttctaatttttctctttttcaacttgaaaaatattctcaaaattattaactaccctgaagatactttgtctttaggggaggagggctgaggaagaaggcatacataattacttcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaatgctagttcttttaagtttgtattaagtttaaatggtaaaatgcatataatttaaattttatgtatttttatttcagaacattttttaaaatattaaaaattattttttagtcttgtagtcattacaaaattataaacgagttgtatactggttcctttttgaggtctacaaacatgctcgtgtatcttccaatgc

SEQ ID NO: 6285 - DNA, 217 bp, Homo sapiens
gagaaaccaaacatgtttatgaaattaacacgttctgaaagattagcacatccaatctatggtaaattttagcaaattcaaaacagagtgaagcctgaactgtcattttccagcatctcatcactaagggaaggttgttttcaactggaaataactaattcctttatgctttattatttaaatttctgtttaagaataatgtgtagttattattttt

SEQ ID NO: 6286 - DNA, 9925 bp, Homo sapiens
aacagtcaataaatacatgtttattgattaaactgaattataaaaaacaaaaccaaaaaaaaatttccttctactactaagccatgcaggcagagtccacaaagacaacttcctggccaaaacccagctgatccactgttggtataatcttaaaaaaaattacccatcaagaaagtcaatcgtgtgcagaagacaggaaccccagctctgctaaggctgtggctgctgcagagactaccaaagagtaggattaggttgtagatagacgtgaccaaccatagttcttgaactttctcaaaggcaaaggctgacttcaaagtccattgtctgtcaataaaatggcatcaggcaaaaagctggggaagagaagcccagatggatccttggttgttttcagatgtcaaaggttcacaaagctggccaagctgtttctggaagggacttttccagttcactatattatagtgtgctgggggatgaaaaaacaaacaaacaaaaaagcagggtggggtgggagaaatgggtggtaacaaatgtcacacctgtaccaccaggcccatcacatcttgagcattccccagtctgtgaaagcctattaaacagggtcacctagaaaaaaaacaagtttataaatccatttcccctcattttattaaatgttccacttatgtacattttaaagacgaaccatttacaagcttgtgcagtttgcctccttggctcacaggaggggaacattgtggaaagcctcaggataaacagaagacttggttttttgctccttttctctgtacggtacagtacgttttggtttacaaccatgagtacatacaattaaaaaaatccctcatgcaaattgtagaaaaaattttctttccttgaagctggcagtgaaaaataaagattcatgtcattttctttgtgcacacccctgtgcgcttcttcctgtcagattcttccctaagtattaagagaaataggggaaagccacagagcacgctggatttcaacaagtggtcttgtctttttaaagttcaacacttcttgaacaattagctcctggctgtaggaccagtaatcccttaaacaggcatgctctccatctaacaggatgaagttcagtaaagcagggactgcccctgggggcttacaggatgaagactcaaactgggaatggcttccaccctaaaactgtttgatcgcttcagtatctcttgcttgctaataacacctgtatgatcctttgtccagagggatggatggtgttgagaatggggaaaggggccaaggatcacaagtgcaaaaaatattgtttatgtcatgttttggagggaaggtggtgaggaaaagacaaatctattcattctggataattaaaggtggtttcatgcatttttaaagccacaattttatatctagggttgctgtagaaaccaacatctctggagagggaaggaaagaaaaggagaaggaagagagagttcagtgggactttttttccattttcatttttatataaaagtgttaagaccacaatgaaaaaagttttttatccatatatataataaaccagtttgtgagctacataatttgtctttcccatcttcagaaatgttctcacattaacaatgattagatagcatcatgcccaaagacattggccacacaataaaacaaacaaaaaaacccagtactatgatacaattgaggtaaaaggggaaacaaaaaaatttaacatttgcccacaaataattttttttctttttcttaattttgtcagaaaaataccaaacacagtgatttaaatttaaaaaaaaaaaaagtcacaaaaacctgtttttagcagaagtgaatgaccaatgggccagctccttggctcagacgtgattactattggttttcctaattaatccacaaatccacagggaagtgtaagtcaacttcaggggggagtggtggtataaaattaaaaaatagaaaccaaataccccacctggtatgcccccttttccctaagcccctttaccctccctcacatgtttccacccccactgcacaccccctaatgaccccaacactcaaatctccatcagatctaggtcagcttcttcaaagccatagaaagactcggtctcactttcaccctcaaagagctggtgaagactttcaggctcaattgtctcttcaggagatgatctgggtcgtggagtggaagactcagaatgttccccactcagcttcagttgctcctctagggaggcaattagctcctcctgcatgtcagcatttcttgtaggtgagttaatgttgccatcggggccaggcagaacactagccaccaggaaggagcgctgaactagctctggacagtccccaatgacacctagcacttcacccagccagacaagcaccagctgaagcaggacatcagaatcacatgcagtatctgccatttcccgagcctgttccttccattttttatgcaggaagttcttgacagttcttttgatgcatacatctaatggctgaattttggagctacagcctgctgggaccactgcaggcaaagtgctagaggcactaagcatagccagtacctcttctgacaagtgagtgcgatgacagtccatcacaagcatgcctttgctgcgctggcaagctgtgtgcttctgccacactcgagttgaccacagctccatgatctcgtcatcactgtagccactctcctttgcctctagcaatatggagtctggcatgttagcaggctgatccatctgccctctgtagaaaaccagggtgggaaggacagtgccatctgccagaatggctaggactacatcacaccaaggttcccctgtgcccactgtctgcagggcattctcctttcgatcatcactgctcagcacctctgtatccaggaacaaagagatctcatcaatagccacaatcatagacaagggtaagtcctggttgtgaatctgccgttgtacaaaatcaatgaagagtcctgcattctctgctacatccttaggtagggtgtgggccacagctcgccgggcatggggagtcaggtggtgccgcagcatgaaacgcacagcccactcataggagatcttaaaccccccttccaaagaacgtcctattttggtggccttctggaacaaggtctcctcatttacaggtagctgttgttcgcgctgggttagcacccactcagccagtttctcttctgcctcaaagctcagatatttgccctctagattctccccctgggaggcctggaaacgtcgaagccaacggcgaatacgtcgctggggatttcggaagtgttcagctgcctgttctgtattgcagcatagagcaaacagtactactcgaagcttcttcacagacagctgctcctttttgccaactccaccactaccaccaccacctgatgctagctcaggttcttgggtgactgggctcccttcatcctgatcatcaacattcagacattcggctccctctgtagccagcggtggaagggctaaagcctgcgggtgagtgggggttggtggtggggttgcagttgaggctggtgatgggagtgctggggctaagggagttagtagctcttcaggctcagctggggtggcccccgcagatttcacagtggcagctttgttagtggggaaggaaggaggagggtacatattcttcacgttccggtcatgcactcggtcacgagtctggccatgcctaaaggggtgaggagcaaagagaagaggagaaatctcagttcaactaggaaattgaaacaataatatgataataataataataataacagagtaaacacactgcaaaccagaaattaaattgtgaggtgagtttttgttaccttgagtgagctatccaagtgagtcctatggaaaatgaaacaacaaaaatagttagctcagtgaaaaaataagccctccaaagacagtgccctgggattcaacttactacatacaaatacgctgttcgcagtgaccagctttcccagttttatataaacttcaggtcggaaggtttctaattaggtccagcacatctcaacagtgaatgagtgaggccaagtaggtatgctcctgatgcatacagtacgaacctgtatcttttttcctccccttgctcaactaatccccttctctcctacttaccccgtggcaggatgctgctggatctgtgagaggggttgaataccaaatgcttggccatagcatcgcccacagaggtaacaaaggtacatgaagtgcaggccagcttgattccactaaaaaagagaattgagactatgtaagacaaacacagcagtgacacttgagaccattaagctttgaggcttaagaaagaaaaggaatgccctcccactttctcctttttctgaaattaattcacataaccacctctccaaataatgaaaaacctgaaaattaatgtaaaaacctgaaaaattaagatgctgccaataagttttttcttacctcacagaatttttaaacaaagccaaatacttggggctcttccgtggaacatgattgctgagaaagacaaagaagtggtatgagttacggagttctgctggctaagctagagatcaccagccagtgacaatgcccccaacaaaagagacacttcttcagtgcaccctaatctcaacctaagccagttttcctgtcaccatgcttcttaaactttaatatgcatacaagtcactgaggatctattaaaattcacattctggttcagtaggcctagggcggggctgagagtcagcatttctaacaagctcccacctaatactactggtacttgaatagcaaggccctatgaaattagagcacagaccatcaaaaccgaaaaaacagagcctctcactctgctaggagagaagaacaaatagctctaagagttgaaggaggaaacatattagaagcaggggagaaaatgaaatgagtgctcaagaatctggctggggccgggcgcagtggctcatgtctgtaatcccagcactttagggaggccgaggcaggtggatcacctgagctcaggagtttgagaccagcctggccaacaaggtgaaaccccgtctctactaaaaatacaaaaaaatcagccaggcatggtggtgcacacctataatcccagctacttgggaggctgagacaggagaatcacttgaacccaggaggcagaggttgcagtgagccaagatcatgctattgcactccagcctaggggacagagtgagaccctgtcttcaaaaaaaaaaaaaaaaaagaagaagaagaagaaaaaaagaatctgaactctcaagctaaaacactggttaaaaaccaacttacttgatcatgtggttggcataagctcgagaacagcaggtgctatagcgacacagagagcagtgtacgtaagtagggaaatgattagggaagtctgggatctcgaagctgcactccaggcatgtctgccggcccatgacactcctgtgggggagaaaaaaaaagaattctcattactgcctcatgggtccccaaaatgtaggattttcagacaacaaaccctgctaaaaagctaccagattgcactgtgtatcaggaataatcctggccacccagtccccacccgcccagcacttagaagaaggcgctgacattttcctaacagctctcttctggatgctgcgctggacagggggataaaggaagacaggcagagggtccattgaggaggtcagcggtgctgcctcctgcaaggcgctgggaggtgtatcattagaggatacaggaacagttcgtggctgccctcgggaagcccggattgtcacctgagaaccaagggaagtaacaatgagacatcacccacactaaatttcagaatactgaaaatctctattcctccctccctgggcctataaaagacactggcaaactctttaccttggtgcctggtttcaagccctccagctgcttgggtttacggaaggttttatggtgttgaagcttgtgttcaattttgtccttggcaaagagaaactgcagccggcatttgttgcagtgataaacatttctcttctgaagtgggggagggaaaaaaagagacaaaatcccttaaaggttcctaataaattttcttttttgaggagaaagcagatcaatgtcaaccatatcattcttcccacctttctgttgataatttaagagagtaagaaagaaatatgcaacatgaccacaaaacctaccattgagaatcatcacctcccatgatatcaaagaaagatggattctagtccaggatgactaagttctcaaatcatcctttcctgacttgttttaacaatttgaatgagtgatgtaacctttatttgtattatatctttacactgctgacaactggacattcttctggacattcttcattcttctttttttaaaaaaggacaatgtacatagtaaactaaagtcatacttttttttctatactcttccaactttgctttcaactccaacactcagtccccttccatacaaacaacttattaccagtttcctgagtatgctttcgtgggcagtctacacatataactgtatcacaaatacattcatatccaatcattacctgcctcgccccctttttttgagacagggtctctctctgtagcccaggctggagtgcagtggcatgttcatagctcactgcacgtcccaagtagctgggactacaggcacgtgccaccacgcccggctactttttgtatttttttgtagagacggggtgtcaccatgttgcccaggctggtcttcaactcctgggttcaagtgatctacctgccttggcctcccaaagtgttgggattacaggcgtgcatcactgtgcctggcccttacttttttccctttcctttttgtagagatgttgtctcaccatgttgcccaggctggactccacctcctgggctcaagtgatcctcccacctcagccctcttctttttctccttttaacacaaatgatagcacttgtctataccttgctgttttctcacttaacacatcagtatatacagatatgtctcctggtgagaccactttgaggattcagtctgcctagtattgaagtccttcaaaaatagaacccatgtctatgattttctttagtaggataacaaagctctgtaagcttaggctaagagacaatttccatgcccctatttggaaatacagttgtggtagacaatcagcagtcactactgtgcaaaggagactatgagtgtaatagggtacatatgtttgtgtgcatatgtatgtgactattaagcacacatgcactcatcttattctccattttgaatcctctcttatatactatatacctttcactctcctctagtggctctcttcttgtagtattttaaaacgaagtcatagcttttcatcttataaggaaaataaaagcaataaaaaactcttctttgccacttcttcctctggatttacctaccctgggtcctccctttttataaataaacttctttaaatacatcgtcttcatttccttacctctcattcatttgttctgctgaaatgtgacttccaccctaccaaccaacaaaatggctctcatcaatgttgctaaattaaaggcctgtttctaagtctctatgttgcttgacaccttcctgtaacatatgacattttgatcacacccttttctttaaaacactttcttctccccagtttccttaaggttaagactcttctggttttcctcctagtactatggtggttgctttatagataagggacttcaaatatcctaagccttctcttattctcaacagggttggggggcccatggtatttaagtttaaaatctataggatttatataacgctgattcctaaatcttttctacaacccagagttctctcacaggcttgagatctattatccaacagctacacttgacatccacagatactgctaacttacaatatccaagctcatgatctcccccctcacaaatatactttctctattgtttctatttcagcaaatagttccctcattcacccaactgcccaagacagaattttaggcactattcttaactactgcattgctaccttcacctaatccatctctacatcataaatatcacaaatcttctgaatatctctcaactctaccctctttttatttcaaaagccaatagccactatcatctctcacctaaactactgaaaaaggccttctagctagtttccctaactgtagtctcaatctcctttaatccattctctgcagtgcaggcagtataaagccttaactaaagctgaacacatcactccagggcttaaaacccctttagtggcttcccagtgaattcttttcatggcttaaaagatcctccatgatctgtccctgcctaacttccaacccctctgtctcttacaccctacactgaatctctctcaatttcttgaacctccacaattttgctttgtgccttgggcacactgttcttcgtcttatttcatctggctcattcttattcatccctcaggtattgaacaacacttctttctggaagccttactaggcacccagaatagctatgtgattttctatatcctataatttccccaacacagtactcttcatgttttattgtattgtttgccttgtttactactaaatctctagcatctagactagtacatggcacattaagtgaattcaataaatttctgcaaacatatgcatattataatctctgcccaaattatttgcctagctcagccctggccccagcatccatgtttaaaaaaaaaaaaaacaagagaatatgggaattgcttggtgcctagtacctggtgcctcatgtaatgctgttggaatgcattgccatttttgaagaccttcaggcaataagggcagagcagatgccgggtatcctcatggatcatccgaaaatggacatctacctcagagtagagtgaggagcgatattgacacacctgagtcacataggagggaaaataaggctaagaatgaagtgaacaactgagaggccttaaaaaaaaaggtagcaacaaaaatttttaaattaaaaaaaaaaagttttctcaaatgcatagaaatcaaattattttcctgactttgtaatgctgggctatgtttgtgataggtttagctattactttaaaaataggaagggacagaaagtctaagaataatccatgttctctaactaagaaaaataaagccttttctgtcaatttccaaagggcacgttcaggagacagacactcccttagaatatgcacatgttcccggctagtctacttgtggacatgttcttttatgtttttctcctgcatggaaaccctgaagataaactgtgtttactatttcttctgtacctactcagagttcctaaactgagtgtatgcagtaggtggtcaacaatattcattagtaaattctttgtattcttcctgagggcaaaactgctaaaactccctggagaaaaaggcaatacctggcaaacataaggcatctctccaggcttatgagtatccttcatatgctggagaaatagtggctcactttcaaacgcccattcacagatcttgcacttggctgtaagaagaaaagtaatcaataaatccacttgaaaataagacaaaagtcctgctgactcacaatctttattttctctgcctcctttattttgattttcaacaatcagtaaatcataggtcccttctgttctttctttaaatggctccaccttaacatatatgttgctgataatcttatgtacgtagctcagacttcttaccaaagcttcattctagattttatctataagacattttaaattggttattctatc

SEQ ID NO: 6287 - DNA, 2386 bp, Homo sapiens
ctttcattttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagtaagttctcggcgctttcgtttgcgtagcgggagggaccgtggggcctggtgctgccggctggttttgagagcccgggaaggtgaggcggggaccccgggggcgcgcgaacggcaggggagctcagggcgcggagtcctggagaatgcagaataattggaaggaattatagaaaatcagaagcgcagctcagtgcgcggaaagagggcgcagtccatcccccctctcagctcccaccgttctcactctttaggaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgtaagtcatccagagaacaggagagtggttcccaagtagagaggggagtcccctgttttttattcccttcgatgggatggggggacttgttgcagcgggggactgggagagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaacctaaggtgaaatgagttttgacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaaccgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgcttgctga

SEQ ID NO: 6288 - DNA, 334 bp, Homo sapiens
atttttgtcactttaatggaattagtttcaagtttttgcaaatatgaaaactggaagcttaaagccttgggcatttactggacaatgtctaacctccccccgcccccagccccctacaccccagccaaagaaatatgaataaagttgaaataattcttttttctttttttaactaccgagaaccctggatttttgttttgagacagagtctcgttctgtctcgcacgctagagcgcagtggctcaatcatggctcactgcaaccctgacctcccaagctcaagcaatcctcccatctcagcctcccaaagtaccagaattacaggtatgagcca

SEQ ID NO: 6289 - DNA, 6677 bp, Homo sapiens
tggtgaaatgcaacttcaatgtggaggaggccctgcgaaggctgcggttcaacgtgaaggtgatccgaggtgagcagcggtctgggccttccttccgctgcggccccgccctgggcactgctgaccgttctccccggcctgggccttccttccgctgcggccccgccctgggcgccgctgaccgttctccccggcctgggccttccttccgctgcggccccgccctgggcgccgctgactgttctccccggcctgggccttccttccgctgcggccccgccctgggcaccactgaccgttctccccggccgtgtttgcagatgggctctgtgcttggagtgaagaggagtgcaggaactttgagcacggcttccgtgtgcatggaaagaactttcacctgatccaggccaacaaggtgcggactccactgccaggctccaccgggggcttctcgatctggggaggggctcagggtccgcaggcacacagcacacggccgactggaggcctggagccccgtgtcctgtgtccgcctcctcaccgtgtgcccattgctgtcttctgcattttttgctactgactgctgtgggcccctttcctgtccccacaagaacaaggctctggctttgggaaagaatgtggcaaaagctgaattctagtagttgtttctgcctcacattccaccccagggccctgggcacctcatcttcaagtctgtgtcctctgagcagagcctgctggctcagtgtccagcattggccccacagcagaacccctgacacctggagaccaggggtctcctggttccctcctccagggacccaggtcctgccacccgggacaaaccctcatgacaggcaggtgctgccaagtgccggggccttctgcccttccttagaccttccccacgtcctctgtgggtctctgcatgtctgcagcagtgccctctgccctgtggcttcttgagtggtaacttccaagccagcctcttggcagtcagacatctctggctgaaaaccttcccatggctctgaccagtggcttctccgcctctgtccacgccccggttgggcactgagtcccttcaggaccagtgggctgtggccttgttgccgagccttgcttctgcctcgtgtcctgggaccgtgctccatttggggcccgatgtcgtccactgaagggcttgggtgaggaggcacctgcccggggctggttgtacggctcaggacattgctcaggtgactgtgcggtgccgtgcgcagcagcgatggactgtccttgtcagactccagcaccacgtggtgttttgattggagacagcggggcgaggtgtggctggagtgtggtgctcccaggctacacttggagcccctgtcaagtttctgtagctccgggccgtgtttctggagttgtgggccgtgtttctggactcctggccgtgtttctacagctccaggctgtgtttctggactctgggccgtgtttctatggactccgtgtttctgtagctccgggctgtgtttctacagctccgggcccatgttcctatagctccgggccgtgtttctatagctctgggctgtgtttctggagcttcgggctgtgtttctggactctgggctgtttctatagctccgggctgtgtttctatagctcccggctgtgtttctgcagctcccggccgtgtttctatagctccgggccgtgtttctgcagctccgggccgtgtttctatagctcagggccgcgtttttgtaactcccggccgtgtttctggagctccgggcaggtcctggcccagccgcgaggggccgtgtgtagccagcacacgttggtcagcctgagccagtgcgtatttcaccctggcccttcacagaagagctccctcgtggcgtgcgtttgaggtttgccctgcagggaggttgtctcggtctcgcccccaggcaggaccccacgttgttctcgcagcggtgagcatggggcatcctcgttctgggtggcggtgggttagttggcccagagcatgtccaggtgagggggtcttttccgccatcaccagcagtggccacagcctcaagctctctgtgggatgagcctcccgggtggagatgttggaggtgttgccaggtgtgcgcccagctctgtgccaggtgccacatggaacacacttgctgtgtgtcccttctcgtgtccctgaagccttgtgtgcgtgtgtgtgtgtgtcccttctcgtctccctgaagccttgtgtgcgtgtgtgtgtgtgtcccttctcgtctccctgaagccttgtgtgcgtgtgtgtgtctcttctcgtctccctgaagccttgtgtgcgtgtgtgtgtgtgtcccttctcgtgtcctgaagccttgtgtgcgtgtgtgtcccttctcgtctccctgaagccttgtgtgcgtgtgtgtgtgtgtccctatctcgtctccctgaagccttgtgtgtgtgtgtgtgtgtcccttctacgtctccctgaagccttgtgtgcgtgtgtgtgtgtccttctcgtgtccctgaagcctatgtgtgcgtgtgtgtgtcccttctcgtctccctgaagccttgtgtgtgtgtgtgtgtgtgtgtcccttctcgtctccctgaagccttgtgtgcgtgtgtgtgtcccttctcgtctccctgaagccttgtgtgtgtgtgtgtgtgtgtcccttctcgtctccctgaagcctgtgtgcatgtgtgtttggccctttatgtgctacgttgggaattttgtcgggttcacagaacccatgtgtccttctgcggtgtcttctgtgcacttgggaagcattcgctgggccctggagggatgtgttcggtgggaaagcaggcgccgcgggcttgtgcctcttcctcccggggaaggggctcagtccaggagtctgtggacccgggggttgtcactcccactcccaccccgggcctgtgagaagcaggcagatgaggtggacgcaactggcccgtggctcatggtctgggatggggtgggtgagcagtagacagaggcctggagggtacgtttgtctggctgatgctacagaagggaaaggggtctcaagccaggagctggagggctctgagggggcttgaaacaggaggcagtgccacagtgctccgagcccctgttccctgtggtgggcatagcctgtggcctgttagggtcatgggtcggggggtcttgcgttatctgagagtggtgggtgctgtgctccttctgtgctgtcccggggtcccaggacgtcctgggatcgtggtgcaggtgctggggctgggcagccggggacagagatggctcctgacccctccccgcaggtgcgcacacggtcagtgggcgagtgtgtcgagtactactacctgtggaagaagtcggagcgctacgactacttcgcccagcagacgcggctgggccggaggaagtacgtcccgtccggaaccacgtgcgtgcagccctccccagcagtaacgacaggcggccaccccgccgggggtgggcacgtgggcgcctgggcggcacctcttgggtgggggcgtctgtcctgtctgccgcccctcatggcgccctctccccacagggacgcagaccaggacctggatggcagcgaccccgatggccccggccgtccgcgcccggagcaagacaccctgactgggatgcgcacaggtgaggcttggggagtatctcctgccctgggggcggccacgggtctggagccgtgagtgaggcccggtggagcctctcctgcctggcgccctgtgctgggccagcctcgccaggaggagtgggcgtctgggtggcggagggcagccacgtgatgtggatgccgctctgtacacctggctgggagaggggagggcagggattacgcttaccctctgggcttgctggaggggtgcatgtggccccactgctggggagccccgtatggtgaggttggggtatttaccaggcctcagtctccggggagggccttcctgccccagggtggggacttagcccgtcaccaggacactcaggaaggacagggtgtccggagccgtcgccaggatcttgcacctgaggccatgacggagcacagcagggcctcgggtagggaccatgtccgatggtggtgtctgatgtggcgtccgaaggtggagacccacacggggagggtgcaaacgaggatcctttgctttctggctctgtgtttagatggttgagtctgggagggtcccccatttccagagtctggttgtttccatggtttgtttgccaaagggtgtccacctcggctacttcctagaattgtggtgaggccccttgcgctgcctgtgggaacaaaacttccaaagaccctgtattagccctcgcagcgcccccggcattgtttacacctaagtctgtgtattccacagaccctgtatttaccctctgcagtgcccccggcattgtttacacctatgtctattgtattctgctctttttaaagatgtgggttgtgacccactgttggtctgatgaactaaaatctacttctaaagctgagacccttaacctggggctcgcggatttcagtgtaactggtgtcttttgtatttgtgtggaggcttttctggggagggatccacaggctttgctggacccagcaaagttaggcaggagcctgcacaggatccgcggctgtgggcaggccccaccctctgttgcgttctctttcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacagtgagtgccaccccatgcccggagcctccgcaacactccaaccaggtccccccagccctcaggctgagcagaggagggtgggaggcatttgccccaaggacccgaggacagtgtggctccacgagcaggctctcagtgtgtctttaggtttattctttacttgtatgtattttttgactggagaatacattcatgtggtccacattctccacaaatgggagcaggtgccaggctgtcccacccctgctccagccaccagctcccctcagggcaccccgggcccggctgccataggctgtgggggaggcaaggctgggagtctcgagtccagcgctcagcactgggctgtgcaggcacgtggggccgcactgacactctctgcgtctctcttggtctctcccctgcagctgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgtccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttaatttacttaaact

SEQ ID NO: 6290 - DNA, 677 bp, Homo sapiens
tgcttttcaggcaacctgaaatggttttttcttcgagtacctgtaaagtactgactctgaagcaggagcgccttaatagttttataaactcaatcaatagaatgaattttttcttttctccctttctttctctctccttccttcctgcctttctttctctcccttcttttcccttcccttcccctcccctccctccctccctccttccctcccttccttccttccctccttcttggtcttgttctgtaacccaggctgcagtgcaatggcaaaatcatagctcactgtaacctcaaactcttgggctcaaggaatcctctggaaagctttttcaaagagatggtcgtaggtcttctcctcaaagatgtttaaaaatgggatcaggctgggctcagttgctcatgcttgtaatcccagcactttgggaggccgaggcaggcagatcacatgaggttgggagttcgagaccagcctgaccaacatggagaaatcccgtctctactaaaaatacaaaactagccaggcgtggtagcacatgcctgtaatcccagctatttgggaggctgaggcaggagagtcgcttgaactggggaggtggaggttgcagtgagccaagatcgcaccattgcactccagcctgggcaataagaatgaaacaccatctcaaaaaaaaaaaa

SEQ ID NO: 6291 - DNA, 677 bp, Homo sapiens; identical to SEQ ID NO: 6290

SEQ ID NO: 6292 - DNA, 339 bp, Homo sapiens
aatgactggcaagagtgaagagaaaatctctggcaaggagaggctagtgagggttggagaggagacagcagaacagatgagagttggggtaccttatgaaaaagggaattaagtgaaaaaaataataatggatgttgagattctccactccccgccttctactcccccaccacttccgaaccttgttgctcctctccaaatggctggcagcttgcatatttttagggcagggctaagtggcacagctcctgaggagtctttcatacacatggttatgggaatgacgtcccctggagtcatgcagggtctagtttgcactgtcatacgtaaaggtcccgg

SEQ ID NO: 6293 - DNA, 10149 bp, Homo sapiens
cggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaaggtcagtgccagctggggatgcagctactctggggctcttgagacttgtggggcacaccccaggccctcatcccaaatcacaggccccaaaaggggctttacccccggggcatctggggcaggcaggaccaggggaaagggtatgcccccgtgtccacaggccagccctggtctgggggtctatcaggagaggccccaggctgggggccagctccttgcagaggcctcactggggacaccccgcaccggccatggggagctaaaattggaaagtggcgagtgggaggcagctgacaaagctatttcacgggctcttcaccatgctccggtttcaagctcctgctccattaacctgatccccagggcctctccacccccacccaactgatgaggaggtgcctccaccctcaggccgacagcacagccatcaggctggcagcctctgctgtgggcaggggcagtggtggtcttctcttaccccagattccagaggggggtcactgagaaacccaatcctgaagggaggcaggcagaagtctgtcccaggtctgccatgtgaccttgacaggtccctgcccctatctggcccatgacccctccatctgtacgaggagaccgtcggctgctggggggcccaggggagatggctacagggctggggatgaagatttaggggaggatcaagggtgggcaaaagggccacatcagccacctcttggccccgtcagcccaagagttgcctggacatgttccctgcttcctccctttaatttgggtcctatgtctgtatccatggagtccttgggaagcccctgagccaggctgaagcgggataggaagggtaaaggtgctagctgagccgtagtacggcccagcagttctccaggggacaagctaggcccccgctggagggagtggtgagactcagccggggcctgattctggtcagcaccttggacagcagccagtgccctccctggccccgcctggccccgcctggccccacatccgctactcctgggcacctcctcaaatagcacagcctccagctggtgcccagggcctgaatacacagagcgctgagagagtggggcagtgtggtcacggacacaggcagggactgggatgtgacaggctggagctcagggacttgttgggggaatgggggtcagtgacaggctggaggcttaatgcgaggatggaggcttggctctaggggcagcacctggggtggtcatgggatctcagggaggggagtgggagtcagagaaagggtcttagagaagctggggctttgtgaggagctaagggagactcactgatcgaggtggggaccctgcaggcagaaacctgactgtagtgatagaggtggggtttctccgcacgcaggtcatgggggccttggcaggagcggttttggcagagggtggggccggtgcctctggaaggtatgaagatgtaaatgaaggtgagggaggcaggctgcgagtgagggctctgcgggcaagagccttgatgggtggggtgggggcaagagcagcagctgggatggggcactggtgttcggtggcctgtgaactgtggggggcacaggggcaggcagagtgatggtacaaggtccccaaggggctggaggggcaatctctcttcagagtgggtccccactggggtggtgggaccatgaggtggggctaggcttggctggagactgtaattccctcacccaacctgtctccccagccctgtccaggctatgggcatcaagacagcattgccggcggctgagctgggcctctactctctggtgctgagtggggccctggcctatgctggccggggcctccttgaggcttcacaaggtaatggctgtgccccggggcaggtggacaggacccttcttcccctggaggcctcagggttccaaccagcaaagccagaaagttacaggctccagacctagggtactccttctagaacacggctggatctcccttttcagcccggggttcccatctcagatagtcactggaggctgggtggagccaggttcagtcacaggaacacagagatgcagagacactgacagagagatggacacagagtcacacacatagacacacacacacacacacacagaggcctggacccagacacacacacacagagacctagacccagacatacacacacacacatcccgacacacacacacacacacagagacctagacccagacacacacacaaacacacagacatatacacacaccccccaacacacacacacacacatacacacacagagacctggacccagacacacacacacagagagagacctggatgcagacacacacacaaacacacagacatatacacacacaccccaacacacacacacacacacacacacacagagtcctggacccagacacacacacacagagacctagacccagacatacacacacacacatcccgacacacacacacacacacagagacctggaccccgacacacacacaaacacacagacatatacacacacaccccaacacacacacacacacacagagtcctggacccagacacacagcgagacccagaaagaagcagatgcagcaccaaagagactcagacccgtgccccgttcctgatgccctcgctccccagggtggggcagccttgtccacgggggaaggtggggcaggggatgtgaaggcccctctccctgaggccacactctgttctcagatggggcccacaggaaggccttccgggagtctgtgcgacctggctgggagtacattggccggaagatggtaggtcccccacatcccagggtccctcccatcccgaacccttctctgctctctgctgttccagatgttggcaagtaacagagagcttctcacagctctggggcctctggcttgagcttcagtgccttcagcttctttactggcccctcctgtatcctcctgggacatcaagtttgcccgggccctgctcacttgggaaataggtcgcattagtggagtgtgcttcagtggagcctccagcacctccttcccagaaacaaagcagtaaagggggaatggcaggcaacgtgcggaggagagggggagcttcaagcgacccggcagcccccatggtgcccttcactcctctctaccctcctgcctcggtacttccttcacagaggagtgtggagacctgcaggcactgctcttgtgtttgcataaagaggacacgttgggtttggctagtggtaaaaaataattattattattaaatttaaaaatgataataataaaagaagaacatgaaggctgggaaaggtgctggggctctgaccagcccaggttccagctcgtcctgtcccctctcccaccctcacctgccccacctccttctgccccggactgccccaggatgtggctgacttcgagtgggtgatgtggttcacctcctttcgcaacgtcatcatctttgccctctccggacatgtgctgtttgctaaactctgcacgatggttgccccaaaggtgagctggacctgggccacccagcctctccctgccagctcctctttcaccacaagggttgtgggaaccccctcctggggtcacgcccccatttatatggcgaaactgaagccttctccctgcccacagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcaggtgtgaactggtgcaggggtagagggtgtagggataagatcccaaacctctcacttcatccaaagtccttgcaccccaagtatccccaagtattcccttcactttccacctgtcttcaagcctttgggtatgtcctggccacaaggtgagcacctgcatcacaggaggaactatccagatcatcccctgctcctcgcattgctgggatagagcagtggccaaagttaactggctctggaagagaggaagggacaggaccaggctgggcccctgtgggaagctagggagtggggaataggttttccagagacaggaggcaccctagtgagctggtggcctgttctttccccctccagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgaggggacaccctgtgggcttctagaacagggctgaatctcccttttcagattggggtttccatctcagatagaattccccaagcaggctgtatccccatcctcaggcatgattccaggatgaagccgtgtctcccctccctcctcagaccccaggatggggccacctttcccctccagcagggaccccagggtggagacatgtctcttttctcagacaggactcccaggccacgaatgttcccttcccactcaaatggggctcccaggacagaactgggtctcccatggctggctgtgaatcctcctcagactccagggtgacctctgtctccaccctcaggcaggactcctggataaagccatggctcctcctgccccaagtagttggtgagcccccctcagacagggctccccaggcagggcttgcctcttccctcagacccttcgcatccccccaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcggtgggtccacagaagagaaatgggggcagggctgccgccccaggaaaacagaccctctgcacccccacggtgccacagtcaggggagctgaggcacgcagggcacagcacctgagggcgtgggagcaggggcttattctttctaatgcatgggtcttggcattagcttcatcctgtggggccagagcagcatcccacggaccccacccacttcaccaggcatgactgatttccacaatatgggggggtctccgtggggcgggcagagcctggtgtctccccaaggaagtggtgggacagggtcttcatgggggcaggccccaggcgattggaccccaggcagtgacagtgccctgcccccagctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgtgagtgctggccaggacgggggaggctcaccccctgggaccacaccttcccctagcctcttcccccatgcctggggagctctgcgcctgatggcaacatgcccatctgctttcctcttacaggcactttgaccgtggcatcaacgactggctttgcaagtgagtaggagtggggtgggggtggtcacagccatcctgccaggtgtctgagcagggcagtgccaagatgggtccacattttaaaagatcacccctgggccaggggaagcaaagagggcagtgaggaggtattggcagaggtctgggtgaaagatatagaagttaggatttaagtgagggccctcgaggtggagagaggtggtgggaggagggtcacacagtcagcagcctgaacaggacgtggccatgaactgtgggtgttgggaaggagaaggagatgacgctcaaattgctgtctgcagcctgggaggatggagggcagtttccagagagggcttcagtttaagaaatgtatagtcgcaatctaggagacatccctgtggaggttcagggaggtggttgggtctgagggtctgggtttctgagggtccagaggactgatggaactcagagcgtcctgagtgtgggcaggtggtttttaggctttgggagtgggtaagtcctcaggagagggagtggtgtgagaagaggagagacggggatggccgagattcagcctgcaagagctctgcttggaaggaaaaggagccagcagaaaggactggaaagagtagttggaggggcaggagaagaatcaaggtcatgtgccaccctggaagccaagggaagaccatccaggcatggtggggacagcttggtcagatgccactgagcctcaaggaagctggagaccgaggattagtgctggtgacatggaggttttcagcctttcatgggcaaggcaggagcaggtaaggagggaaagtcaactgaggagtagagaagtgtgtgatgactcctggaagaagcctgggactgcagggggaagacaggagtggctgagggagaagagggatgtgttaaagataggagagaatgggacatgctaagaagaattattcaacagagaagctggggatgcaggatacaggggtgattgatggagtgaggtccctgaagaggaaggaggtgagggtgtctagttccaggcggaggcctggcttcagtgggaggaggaggaagagaagccagtgtggatgcagaggaaagcaggttaatgtagacaagtaagggattccacctgaaggcttcagccttgtccatgaagcaggaggcacggccatcagctgagaaagccaggacagggacgtggagagaggcaacatatatgcttacccccacaacccagcctggatccccccactcatactatctctccactcatacttgtggggagataagaatacagtggcccttgcagagcaagggagaagcagctgactagagaaatcttggcactgagtacccaggtggtattggaggtggtgggcttatgaactccagcatgtgaagatgtgagatttcccccatggggcttagctgcctgggtgtagctgaggagaaagtaagtgattgggctctcccagatggatgacaaggaagaagtcaggaataagggtttttagattatttatagtcatgactcattggatataagcctgctaaggacggtggtgaaggtgggagggtcacaagatcaatgggattgaagaactgaagctggggggccaggaggtcaagaggagttgggcaaagaatgggaattagaaaggagtgaactttcaagtggtgacaaagttggggcatggccatgggtgtgggtggctgaggtggagtggagaaaaagccattggaaatgaggaggtcgaggaatggagaggctggttattcctgggtcttccacagaacttatttaacaaatatttattgagcacctatgtgccaggcattgttctaggcactggggatacagcagtgaacatggcaaagaccctgaactcatggagcttacagtctagtggggagaaacagaccataaacaggtaaacaaacataaataagataattttagagagtggtaagtgttatgaagaaaataaaattgcaatgggatagaagttgacaacagggtagaagcttctttagtcggggtctaggcaggcttctctgaggagatgatatttgaattgagatttgagtgataaggagatgtggagcagagaataccaggtagagggaacaacaagggcaaaggccttgagacacaaaccaactgtgtgggtgtaaaggtaagaaaggccagtgaggccagcatgatgaactgggggagcatggtggctgatttggtcaggaagggaacagaaaccagaccacttgggatcttctagccagagtaaagagactgagtttattcctattgtaatggggagctattcagagaggttaatcatggaagtgatgtgacctgagctacactcttaaaagatgcctctggctgctgtgtggagaatgaaccatgggggcaaaagcagaaacaagaagaccacttaagaggctcttgcaataatttatgtgagaagagtgatcatcttgactagggtggtggtggtagaggaggtgagtggtggtcaggactgagaggagccaacagaatttgctggcttgcttggatgtgggtgatgaggcaaactgagaatccaagatggcaccaaggcttataccctgagcaactgaatggatggtggtgccattcactgagatgaggacggagctgggtttgagcagggataggggaatctgtcaatcaagtgacatggctagtagcaattgcatatacaaatcaggagagactgggctaaagacacagatttaggggtcatcgtcatagagctagtacttgaaatcttgggtctggatgagatcatttgggaagtaaacgaacagagatagagaagctataatgtcccaggctgagcctgccacaatttgaagttggttggaggaggagctgctacgtgaggtcaggaatgttgaatgcacccagggtgacagtgttgaggaggacgccctgttgtgtgtcctctcccatctcatccctgccctttcccacactcccagtggcccttctcccatctttcctgcagatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggtgagcagggaagacctggggctgggactggctgggtcatagagggcgggggggcactgctgctttctggagttgtccaaacacctggcccctaatccagaactttctcaccaccaccctcttagttgtcagagcaatggctcactctgtaggaatctgcccctccctcccttctatgaggaatggagcacctgggccttgccatgttggtcaggccttgtcctctctctggacctgtttccccatgtttaacaaggagggagagctgacctggggctctccgagacccagacatagccccaagacctgactggccaggtgggtaaggctgctgacccaccatgtcctctttcctttggcctcttgtcccgctgcccatgctttcctggaccggataggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacaggtgagggacaggggtgtggggatacagaaggtgccaggcatcagcctcaaggaccgtgaccttccaaaatgcctcctatctccctcatcacccctgggactcagaagggagggcccatcaagcggggagaggggtgggaagacaaaagtcgctgaggatgcagtgctgctcctgagcatctatgactccctccccacacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaacag

SEQ ID NO: 6294 - DNA, 10146 bp, Homo sapiens
cggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaaggtcagtgccagctggggatgcagctactctggggctcttgagacttgtggggcacaccccaggccctcatcccaaatcacaggccccaaaaggggctttacccccggggcatctggggcaggcaggaccaggggaaagggtatgcccccgtgtccacaggccagccctggtctgggggtctatcaggagaggccccaggctgggggccagctccttgcagaggcctcactggggacaccccgcaccggccatggggagctaaaattggaaagtggcgagtgggaggcagctgacaaagctatttcacgggctcttcaccatgctccggtttcaagctcctgctccattaacctgatccccagggcctctccacccccacccaactgatgaggaggtgcctccaccctcaggccgacagcacagccatcaggctggcagcctctgctgtgggcaggggcagtggtggtcttctcttaccccagattccagaggggggtcactgagaaacccaatcctgaagggaggcaggcagaagtctgtcccaggtctgccatgtgaccttgacaggtccctgcccctatctggcccatgacccctccatctgtacgaggagaccgtcggctgctggggggcccaggggagatggctacagggctggggatgaagatttaggggaggatcaagggtgggcaaaagggccacatcagccacctcttggccccgtcagcccaagagttgcctggacatgttccctgcttcctccctttaatttgggtcctatgtctgtatccatggagtccttgggaagcccctgagccaggctgaagcgggataggaagggtaaaggtgctagctgagccgtagtacggcccagcagttctccaggggacaagctaggcccccgctggagggagtggtgagactcagccggggcctgattctggtcagcaccttggacagcagccagtgccctccctggccccgcctggccccgcctggccccacatccgctactcctgggcacctcctcaaatagcacagcctccagctggtgcccagggcctgaatacacagagcgctgagagagtggggcagtgtggtcacggacacaggcagggactgggatgtgacaggctggagctcagggacttgttgggggaatgggggtcagtgacaggctggaggcttaatgcgaggatggaggcttggctctaggggcagcacctggggtggtcatgggatctcagggaggggagtgggagtcagagaaagggtcttagagaagctggggctttgtgaggagctaagggagactcactgatcgaggtggggaccctgcaggcagaaacctgactgtagtgatagaggtggggtttctccgcacgcaggtcatgggggccttggcaggagcggttttggcagagggtggggccggtgcctctggaaggtatgaagatgtaaatgaaggtgagggaggcaggctgcgagtgagggctctgcgggcaagagccttgatgggtggggtgggggcaagagcagcagctgggatggggcactggtgttcggtggcctgtgaactgtggggggcacaggggcaggcagagtgatggtacaaggtccccaaggggctggaggggcaatctctcttcagagtgggtccccactggggtggtgggaccatgaggtggggctaggcttggctggagactgtaattccctcacccaacctgtctccccagccctgtccaggctatgggcatcaagacagcattgccggcggctgagctgggcctctactctctggtgctgagtggggccctggcctatgctggccggggcctccttgaggcttcacaaggtaatggctgtgccccggggcaggtggacaggacccttcttcccctggaggcctcagggttccaaccagcaaagccagaaagttacaggctccagacctagggtactccttctagaacacggctggatctcccttttcagcccggggttcccatctcagatagtcactggaggctgggtggagccaggttcagtcacaggaacacagagatgcagagacactgacagagagatggacacagagtcacacacatagacacacacacacacacacacacagaggcctggacccagacacacacacacagagacctagacccagacatacacacacacacatcccgacacacacacacacacacagagacctagacccagacacacacacaaacacacagacatatacacacaccccccaacacacacacacacacatacacacacagagacctggacccagacacacacacacagagagagacctggatgcagacacacacacaaacacacagacatatacacacacaccccaacacacacacacacacacacacacagagtcctggacccagacacacacacacagagacctagacccagacatacacacacacacatcccgacacacacacacacacacagagacctggaccccgacacacacacaaacacacagacatatacacacacaccccaacacagacacacacacacagagtcctggacccagacacacagcgagacccagaaagaagcagatgcagcaccaaagagactcagacccgtgccccgttcctgatgccctcgctccccagggtggggcagccttgtccacgggggaaggtggggcaggggatgtgaaggcccctctccctgaggccacactctgttctcagatggggcccacaggaaggccttccgggagtctgtgcgacctggctgggagtacattggccggaagatggtaggtcccccacatcccagggtccctcccatcccgaacccttctctgctctctgctgttccagatgttggcaagtaacagagagcttctcacagctctggggcctctggcttgagcttcagtgccttcagcttctttactggcccctcctgtatcctcctgggacatcaagtttgcccgggccctgctcacttgggaaataggtcgcattagtggagtgtgcttcagtggagcctccagcacctccttcccagaaacaaagcagtaaagggggaatggcaggcaacgtgcggaggagagggggagcttcaagcgacccggcagcccccatggtgcccttcactcctctctaccctcctgcctcggtacttccttcacagaggagtgtggagacctgcaggcactgctcttgtgtttgcataaagaggacacgttgggtttggctagtggtaaaaaataattattattattaaatttaaaaatgataataataaaagaagaacatgaaggctgggaaaggtgctggggctctgaccagcccaggttccagctcgtcctgtcccctctcccaccctcacctgccccacctccttctgccccggactgccccaggatgtggctgacttcgagtgggtgatgtggttcacctcctttcgcaacgtcatcatctttgccctctccggacatgtgctgtttgctaaactctgcacgatggttgccccaaaggtgagctggacctgggccacccagcctctccctgccagctcctctttcaccacaagggttgtgggaaccccctcctggggtcacgcccccatttatatggcgaaactgaagccttctccctgcccacagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcaggtgtgaactggtgcaggggtagagggtgtagggataagatcccaaacctctcacttcatccaaagtccttgcaccccaagtatccccaagtattcccttcactttccacctgtcttcaagcctttgggtatgtcctggccacaaggtgagcacctgcatcacaggaggaactaccagatcatcccctgctcctcgcattgctgggatagagcagtggccaaagttaactggctctggaagagaggaagggacaggaccaggctgggcccctgtgggaagctagggagtggggaataggttttccagagacaggaggcaccctagtgagctggtggcctgttctttccccctccagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgaggggacaccctgtgggcttctagaacagggctgaatctcccttttcagattggggtttccatctcagatagaattccccaagcaggctgtatccccatcctcaggcatgattccaggatgaagccgtgtctcccctccctcctcagaccccaggatggggccacctttcccctccagcagggaccccagggtggagacatgtctcttttctcagacaggactcccaggccatgaatgttcccttcccactcaaatggggctcccaggacagaactgggtctcctatggctggctgtgaatcctcctcagactccagggtgacctctgtctccaccctcaggcaggactcctggataaagccatggctcctcctgccccaagtggttggtgagcccccctcagacagggctccccaggcagggcttgcctcttccctcagacccttcgcatccccccaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcggtgggtccacagaagagaaatgggggcagggctgccaccccaggaaaacagaccctctgcacccccacggtgccacagtcaggggagctgaggcacgcagggcacagcacctgagggcgtgggagcaggggcttattctttctaatgcatgggtcttggcattagcttcatcctgtggggccagagcagcatcccacagaccccacccacttcaccaggcatgactgatttccacaatatgggggggtctccgtggggcgggcagagcctggtgtctccccaaggaagtggtgggacagggtcttcatgggggcaggccccaggcgattggaccccaggcagtgacagtgccctgcccccagctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgtgagtgctggccaggacgggggaggctcaccccctgggaccacaccttcccctagcctcttcccccatgcctggggagctctgcgcctgatggcaacatgcccatctgctttcctcttacaggcactttgaccgtggcatcaacgactggctttgcaagtgagtaggagtggggtgggggtggtcacagccatcctgccaggtgtctgagcagggcagtgccaagatgggtccacattttaaaagatcacgcctgggccaggggaagcaaagagggcagtgaggaggtattggcagaggtctgggtgaaagatatagaagttaggatttaagtgagggccctcgaggtggagagaggtggtgggagagggtcacacagtcagcagcctgaacaggacgtggccatgaactgtgggtgttgggaaggagaaggagatgacgctcaaattgctatctgcagcctgggaggatggagggcagtttccagagagggcttcagtttaagaaatgtatagtcgcaatctaggagacatccctgtggaggttcagggaggtggttgggtctgagggtctgggtttctgagggtccagaggactgatggaactcagagcatcctgagtgtgggcaggtggtttttaggctttgggagtgggtaagtcctcaggagagggagtggtgtgagaagaggagagacggggatggccgagattcagcctgcaagagctctgcttggaaggaaaaggagccagcagaaaggactggaaagagtagttggaggggcaggagaagaatcaaggtcatgtgccaccctggaagccaagggaagaccatccaggcatggtggggacagcttggtcagatgccactgagcctcaaggaagctggagaccgaggattagtgctggtgacatggaggttttcagcctttcatgggcaaggcaggagcaggtaaggagggaaagtcaactgaggagtagagaagtgtgtgatgactcctggaagaagcctgggactgcagggggaagacaggagtggctgagggagaagagggatgtgttaaagataggagagaatgggacatgctaagaagaattattcaacagagaagctggggatgcaggatacaggggtgattgatggagtgaggtccctgaagaggaaggaggtgagggtgtctagttccaggcggaggcctggcttcagtgggaggaggaggaagagaagccagtgtggatgcagaggaaggcaggttaatgtagacaagtaagggattccacctgaaggcttcagccttgtccatgaagcaggaggcacggccatcagctgagaaagccaggacagggacgtggagagaggcaacatatatgcttacccccacaacccagcctggatccccccactcatactatctctccactcatacttgtggggagataagaatacagtggcccttgcagagcacgggagaagcagctgactagagaaatcttggcactgagtacccaggtggtattggaggtggtgggcttatgaactccagcatgtgaagatgtgagatttcccccatggggcttagctgcctgggtgtagctgaggagaaagtaagtgattgggctctcccagatggatgacaaggaagaagtcaggaataagggtttttagattatttatagtcatgactcattggatataagcctgctaaggacggtggtgaaggtgggagggtcacaagatcaatgggattgaagaactgaagctggggggccaggaggtcaagaggagttgggcaaagaatgggaattagaaaggagtgaactttcaagtggtgacaaagttggggcatggccatgggtgtgggtggctgaggtggagtggagaaaaagccattggaaatgaggaggtcgaggaatggagaggctggttattcctgggtcttccacagaacttatttaacaaatatttattgagcacctatgtgccaggcattgttctaggcactggggatacagcagtgaacatggcaaagaccctgaactcatggagcttacagtctagtggggagaaacagaccataaacaggtaaacaaacataaataagataattttagagagtggtaagtgttatgaagaaaataaaattgcaatgggatagaagttgacaacagggtagaagcttctttagtcggggtctaggcaggcttctctgaggagatgatatttgaattgagatttgagtgataaggagatgtggagcagagaataccaggtagagggaacaacaagggcaaaggccttgagacacaaaccaactgtgtgggtgtaaaggtaagaaaggccagtgaggccagcatgatgaactgggggagcatggtggctgatttggtcaggaagggaacagaaaccagaccacttgggatcttctagccagagtaaagagactgagtttattcctattgtaatggggagctattcagagaggttaatcatggaagtgatgtgacctgagctacactcttaaaagatgcctctggctgctgtgtggagaatgaaccatgggggcaaaagcagaaacaagaagaccacttaagaggctcttgcaataatttatgtgagaagagtgatcatcttgactagggtggtggtggtagaggaggtgagtggtggtcaggactgagaggagccaacagaatttgctggcttgcttggatgtgggtgatgaggcaaactgagaatccaagatggcaccaaggcttataccctgagcaactgaatggatggtggtgccattcactgagatgaggacggagctgggtttgagcagggataggggaatctgtcaatcaagtgacatggctagtagcaattgcatatacaaatcaggagagactgggctaaagacacagatttaggggtcatcgtcatagagctagtacttgaaatcttgggtctggatgagatcatttgggaagtaaacgaacagagatagagaagctataatgtcccaggctgagcctgccacaatttgaagttggttggaggaggagctgctacgtgaggtcaggaatgttgaatgcacccagggtgacagtgttgaggaggacgccctgttgtgtgtcctctcccatctcatccctgccctttcccacactcccagtggcccttctcccatctttcctgcagatatgtgtataaccacattggtggggagcattccgccgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggtgagcagggaagacctggggctgggactggctgggtcatagagggcgggggggcactgctgctttctggagttgtccaaacacctggcccctaatccagaactttctcaccaccaccctcttagttgtcagagcaatggctcactctgtaggaatctgcccctccctcccttctatgaggaatggagcacctgggccttgccatgttggtcaggccttgtcctctctctggacctgtttccccatgtttaacaaggagggagagctgacctggggctctccgagacccagacatagccccaagacctgactggccaggtgggtaaggctgctgacccaccatgtcctctttcctttggcctcttgtcccgctgcccatgctttcctggaccggataggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacaggtgagggacaggggtgtggggatacagaaggtgccaggcatcagcctcaaggaccgtgaccttccaaaatgcctcctatctccctcatcacccctgggactcagaagggaggcccatcaagcggggagaggggtgggaagacaaaagtcgctgaggatgcagtgctgctcctgagcatctatgactccctccccacacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaacag

SEQ ID NO: 6295 - DNA, 802 bp, Homo sapiens
actttgagcaacaaccaaacaaaaaaagtctgaaaattgaaaagggactcagatttgagagaattgtccccactccccaccatatctttcctagtggcccttgtggcatttgggaagctggccccagggccaagtgctggtcttagctcagtcagcttcctgtccctcacgtgggctggccttgccaggtgccctcccctgccacccccctcagacacagtggagctggcctcaggctgtccaaccacagatccatgggacttccctagccctccacccctcttgccatttccgcacaccacactccctgcagaccctgctgtgtgtgggtcacccagggaaggcctcacttctgagtgtgaatccagcctttctgggcctctgggggtcagggtgtctgtggctctctaatagcctctgtttatgagcaaggctcttgtcatggagtgaatcaccggatgccccctgccaccccagtgagggccagggccagcggtatgcccattttacaactgaggatctgaggccctaagaagtgggtcacaccagctcagggtcaagtaaattggctgaacctgtgttcttaactctggggtcaaaccaccctgtctgctcccttgagccattttcttggagcctcgtgagggccccagtgtgggtgcacggggttgtcgcccctgcagggcagtcagtgccaggagcttacagggctgatccaactacttggcttcctcatgtgccaggtccttcttctcccaactgcgtacagtggcaacatcttccctatgggctgtggtgacat

SEQ ID NO: 6296 - DNA, 6150 bp, Homo sapiens
gacaccagatggagagcagagaccatcgaccttggcagcccaacagcagaacactgaagccccaagtcttcaacacacctgctcactgactcttggagcactgatgcagaccctgagctgcttgctcagaaggcactttattcttcctaaagaaggagacatatctgcactgtacactgcacttgatggggatgctcccatcggaaagacgagaaggctgagtcctgtggggaactttgccagcacactcagctaggctggggcagggccagcacacggcctgggataccgccctgtggttctggttcatggatcaagacaacctagggggatatggcaacactggagaagcctctagtttctcacccttgcccaaaagtccaggactaagcagcacttccctttccttggctgacgcagcccctgaggcaccataactggatccaggtagactctggcctctcctagcctcttttctggagcccccacaaggccaggccagtgagggtcgcaggatgggaggggtgcttagttcagtctgcctgagctggtcacatcttagtcaggcacagcacattgagccgcactggtaggaaggtggcacctgctgcataggcgatctcccgcaggacaccctcccatttcttctcctcctcgttatacctggggatgagagagagtggggacaaggatggagagcttggtcagctgagtccagagtggaacgcagcagagaggggtggctgagggcacttggcccatctctagggagatctgctcctgaaaatccccaggctctgggaaaggagaccccccacaagacccaccccaaggaacacccaccccacactccaggaagggtctttctccccaggaaagatcacctctcaaggggtgttcccatattcctcaaagttcccctccaggaaggtctacactgcccacaccaccccatcaatgtcctctccttgagaatttccatgctccatttctactaagtctcacgtctcagcctccggcagcactgctccccaggggctgcctgcagcagtgcagatggctgcaggttcaggaaggagatgccccagaggctaaagtttccttctcccacccccacaaaggaccagccatagagagcaatggttctgaaaggccagggctccaactgtttcccagccctagtggcagccctccctccagaccaagcacccggaaggcaggagagaagaaaatccggctgctatttgggccctgtttctgtgagtctatgacctaagcttgggtctgctcccatctgcaacactgttgctgctccacagtggggcatggtgtcatctgtgcaagcccagactttcccaacaaactggtgagaaacggccaagcagggtatgttggctattcctccctacaggactccctagaagagggatccgctttgcccccagaggagcttgcccagtgccttggtaccccaccatggtgctatggggtgtcagccttgctcatgatgcccccttgcctccccagggtgggactcacctccagatgtcattgagctctgtgggaaccagctctccagactccgtctccagtgtggcaaagccaccaatggcatagagggtacccaccaggctgaccaggctgagtgagctacgctcctgtgggaaggcctcgaagggtgcccacctgggggtgtgtgagaaggtgcatcattgggatgcctcggcaagcccagtgactgtccctgccacccagcacccacagctccaactgcaaccctttgcaatccaagtcccaggcacccatgcccccaaccccattccccttccctgtccctctggtcttcccttccttccccattctcttgctcctccactttcctttccttgtcctcttgccattctatccaacctgtccagcaaagtccaccatggatctccccactgcccctactcctctcctgaactaactccaccctccaactcacaaccccagcccctagcaggcccccagccttgccctggacgcagtccttttgcccctcagcggcccctgcagccccacccaccttgcacacctgctctatccttcttctcccttcacagcccagttgttctcaatgtatcttcgctaccctggctcctgccttgggccttagtcccatcctccaaaactgaccttcctgaggtccacagtcactgcacacgcactgaggtcctacagcacacagccctgctgacgtgactttcctcacccatctcttcggcctcaccttcgtggcctccttcctggataatgcagctgcctccaccatcagggcttggacctcagctcctcccatttacactctctctcctgagggagcttggcccctccgtgtgctactgacccccagatctctccctccagctcagccctctctctcccgggtggggtccttttggacacccccaggtacttcaagtccacatgtcctaactggaccctcactttccctacccaatcccaatgattatccagtaaatggcctcccaccctcactcagaagcatgtacttctccccctctcacccccacatccaatcaatagctaagccctgtttctcccacctcctagactcttgctactcaaagtgtggttcatggcccagcagcgtcagcatctcctgggggtgcgttagaaatgcagacttacaggctttcagccctccgcataccgagaatcagaatctgcactttaaggcgatccccaggagatttgcatgcccatcacagtgtaagaagccctggcctgtctttgtccggtgcatcccctcaaccccatctccgctgtgcccccagctccaggcctttatcacccctgaccttcctgacccctgggaaatccctaatctgctctctatatcagttgccatgaagtactttagtagaacacagatgagatacagtccctctcctgctggcccccgctccagccccagcaccgccatcccaactccatcacccacccacctccacccagctggagcaacaccttccctcctataggccttgagttttttctccaaactgcctcagcaccacctttccttagtctggggcaacctcctcccaccaccctcaccccttttgcgagctgagtccaactgtctctcagttcagttttctcttttctgatgtcccaggcagggcagcttctgtcttgttcactgctatatcccttgcaccaggccattgcctggtatgagtccctgaatgaggaacctggcatcccctcccccagccctgggagccccctcctgcagaccaggctggccataacccttgccccgcctccccacctcactgctgatcaggagagaaagcctatttctatactgatgtccaaagtcaacactggagacccaagacagggactgcagctcctgctggggctgacagaagcccaaagccatgcagttgtccttggcggaagggacaagctttcatacttgttgtctgtgatgctgtacacttcggcagaactggtcagccctgtgtcggtgaccccagctgccacgataatgcggccatcatggacagtggccccaaagagtgagcgggcggtctgcatgggtgccagctccttccactcaaacttcttggggtcatagacgcacatcttgttcaggcacttcctgtggggtggagggtggggatgggtggagagaagcaggagcccagccacgcctccctgcaatcacctgccggggcagccaggacaaacccctgacagcctctgggagattctacctctgctccacagactcactccaggcccagcctcacctgtcactgcctttgccgccaattacgtagacaaggtccatgtgggagagcactgtgtggccatacaccacgtaaggcagcgggtccgattcaccccatttgaatgacctggaggagacgggagtgggggtgggggagggcacccatccaggctcggctcagtccctgtctctgcacccatccgcccatccacctaacacatattcgagatgcgtcagatccattgctggaacttccgaggcctctcagttctttgatcccaccctgccccccaacctccccgcccttacccaagcccaccttcactctaagcacaaggctctagctccaaatcccaccccaggccctagaccagctgcggcctccatgccccactcacccccacggagctcagccccaccccagccatgctcacagcctgtcgtagcacatgaccgagtccaggcagcgctcgccgtccttgatctctctgccaccgaccacgtagatggagttgagagcttctcccaggccaaagaggcagcggggcgagggcagcggtggcatccccagccactctgagtccagatggtcaaactgcaggccaggtgtccagtcagctaccgccccccactcccccagcctcagcccagccccactcagtcccactgccccagatcacggaggaggtcgggaacccaggtagggccaatacagcctggaggtgccctgagaaacagtgcccctcctaccatcaggctgagagcagatgagcgtcccccacacccaggcaggctcctggcaaccaccattatagcaggcggtagggcaccacagcacagaaatgagggggagctctgtgagggaggtccagctatggccttgctttcccaggctgaacaactcccaactgaggcctgcctgccccctcctctccaccccatcccactgttcaggaaacttccaaatacggccctgccttttcgccctgtaaaatctacagtccacagccttgtccacctccacagctttataattaagatattaatactaggggttcatctttttggaaagttttctgagggctgagcaccttgctgatgagcactttataagcatcatttaaccttccaacaaccttatcatgcaggaaggagaatatccccagttacaaacagaggcccagagagaataaacaatgtgcccacactgctgagctagtagctggtgaagctgccctcatcccccagtgcaaccgtaaggcctgtgagcttaaccctggcaccaagcgcctgtcacccctcttgctgatcaggcctccctgagcacaccactcaccaggctcagccccagttctatcccttgcttaccgttccttggccggaaacactgccatcttccccttcacatctccaaatcccaccccactggcaaggctcaaacttatatggccagtctccaggaaactgtctctgccctttgagatctcacagtcacaccccaactcagacctggcactccactctgctgatacctcctgggcctcagtttcctcatctgtacaatgggaggaccatacaggattgttcctttgtctgggacactgctgtgagctccgggcctggccttcacgcagaggccctgcccaggatcctcacaccgaccttgctgctccttactgtgccccaccccaacccctgtgcagggccagggcctccaacatatgccaacttggggctaccacacccctgaaattaagataccaaagttatgctgctttttggcagctgcctattgactgtcttcaaccttcaagtaggtggctatcagtcaacctccccagtctacatctcaccctagacccagtggcattcacttgtgtagacacaagccccttctgggccccaagactgtccacagtgcctagagcccagcattagctggcggctcccaaggctggtcaggcacctgcaggaagtatgcgctcatggggtcctctttgttgtcttcgttgtagaagaggcctccagccacgaagacctggttctccttggtaaccaggctgacgtggttcttggggacctggttggagagggaagcacagtagcactcgttggctgctggatcgtaggccacagcgccctcctcactgatcatgaagatgagatcctgcaggaacatgccgaagcgcagggtgtcattgaggatcccaggaaggatacgttcggcctcctcatcctcctctgctttggctttgcttgtgcccttatcagcctccttggccccggctccatccttccccttctttttcttccgcagcgtggtgatgcggccctcgtgtgca

SEQ ID NO: 6297 - DNA, 1672 bp, Homo sapiens
gacaccagatggagagcagagaccatcgaccttggcagcccaacagcagaacactgaagccccaagtcttcaacacacctgctcactgactcttggagcactgatgcagaccctgagctgcttgctcagaaggcactttattcttcctaaagaaggagacatatctgcactgtacactgcacttgatggggatgctcccatcggacagacgagaaggctgagtcctgtggggaactttgccagcacactcagctaggctggggcagggccagcacacggcctgggataccgccctgtggttctggttcatggatcaagacaacctagggggatatggcaacactggagaagcctctagtttctcacccttgcccaaaagtccaggactaagcagcacttccctttccttggctgacgcagcccctgaggcaccataactggatccaggtagactctggcctctcctagcctcttttctggagcccccacaaggccaggccagtgagggtcgcaggatgggaggggtgcttagttcagtctgcctgagctggtcacatcttagtcaggcgcagcacattgagccgcactggtaggaaggtggcacctgctgcataggcgatctcccgcaggacaccctcccatttcttctcctcctcgttatacctggggatgagagagagtggggacaaggatggagagcttggtcagctgagtccagagtggaacgcagcagagaggggtggctgagggcacttggcccatctctagggagatctgctcctgaaaatccccaggctctgggaaaggagaccccccacaagacccaccccaaggaacacccaccccacactccaggaagggtctttctccccaggaaagatcacctctcaaggggtgttcccatattcctcaaagttcccctccaggaaggtctacactgcccacaccaccccatcaatgtcctctccttgagaatttccatgctccatttctactaagtctcacgtctcagcctccggcagcactgctcccacaggggctgcctgcagcagtgcagatggctgcaggttcaggaaggagatgccccagaggctaaagtttccttctcccacccccacaaaggaccagccatagagagcaatggttctgaaaggccagggctccaactgtttcccagccctagtggcagccctccctccagaccaagcacccggaaggcaggagagaagaaaatccggctgctatttgggccctgtttctgtgagtctatgacctaagcttgggtctgctcccatctgcaacactgttgctgctccacagtggggcatggtgtcatctgtgcaagcccagactttcccaacaaactggtgagaaacggccaagcagggtatgttggctattcctccctacaggactccctagaagagggatccgctttgcccccagaggagcttgcccagtgccttggtaccccaccatggtgctatggggtgtcagccttgctcatgatgcccccttgcctccccagggtgggactcacctccagatgtcattgagctctgtgggaaccagctctccagactccgtctccagtgtggcaaagccacaatggcatagagggtacccaccaggctgaccaggctgagtgagctacgctcctgtgggaaggcct

SEQ ID NO: 6298 - DNA, 802 bp, Homo sapiens; identical to SEQ ID NO: 6295

SEQ ID NO: 6299 - DNA, 3742 bp, Homo sapiens
agacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaac

SEQ ID NO: 6300 - DNA, 226 bp, Homo sapiens
ctgctcctcacagatgcagtagcctctcccaatttgcaaggctcacctggcattctagacccaagtcacgctccagcccccgactccagggagtcttccctgattgccccagcccaccttgaagcctcagaggcctgcaattacccctcagggaagggccacagctcctgatgactcccctagtatccaggacaccaggcctccacaccccagcctgcccccacat

SEQ ID NO: 6301 - DNA, 243 bp, Homo sapiens
atgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaagg

SEQ ID NO: 6302 - DNA, 22008 bp, Homo sapiens
gcggttccaagtgtggagaaagcggctctgggtctaggtagtgtgcggagaggggcgcggggtggaattgctgcgggaagtgggaaactggaagtgggaaactggaagtggaatctggtgctccggaaagagacgttcccaacttctactttctccccagattgagggatactccccctttccaccatgggcaagaagggcaaagttggcaagagccgacgagacaagttttatcacttggcgaaggagacgggtgagtccggattcgctcagtctgcgagcgagcgagcgatctctgcccggttcgcctgctctttgcgaccattatgtacctctcctgcagaaggggtggtcggttgcgaggccggagaaatcctactagtgaagcagtttgcgcacttggttgttttgtccaggttaccgttcccgatctgctttcaagctgatccagctcaatcgccgctttcagttcctgcagaaagcccgagccttgctggacctgtgtgctgcgccagggggatggttcgtaacactcgccacaggttgctcctggtggccgctttctgggttctgagctgggatggcttccagtttcactgcgggaggggaacccgaatcccggtcctcttgggggccgtttcctttcttgattgcagagaaagggcttggaatacgtgcctatgatatgctttggccagtacacgtaacaccagggatgagagatcagttgccaagagggggaaaaggatggctctaggtttttaaatttctgttccttttataggctgcaggtagctgccaagtttatgcctgtatccagccttattgtgggtgagtaacggacagctctccttggtgttttaaggggtgggtgtataaggtattttgtcctgtatttctctcctccctgcttgaagcaaccttttagaatactctgacctgatttcttccaggagtggacctggttccaatcaagcctctccccaatgtggtgactctccagcaggacatcacaacagaacgttgtaggcaggtaataggagtctctctcttccttccccctttatacggaaacatctacatccctgaaatcctctaaaggcaagtttttcctttttaccgtgctttgagcacgttcttgcctgacatctgtacgacaagacctatggcattcgtagtgtccactccaggctttatttagagtcagggataaaggtgtttggaattgggagaagggcagagatctttagtgaagtcttctcctgtgaattcagtgtcagactgtaatctccatgaaggtagagacatactgtttttgtttactattgtatctcctgtgcctggtactgcatttggcccatgatgggcactcagcaaatgactagatggacaaatggctgaaccagggccattccagtgtttctgtttccatagttccttttcttctctttaggccctgaggaaggagctgaagacctggaaggttgatgttgtgctcaatgatggggcccccaacgttggggctagctgggtccatgatgcttactcacaaggtacagggagtgtggtgcttggagatcaggtgatggtggaggtgggcgcatgccctcctgggctgcagagtgcgtcaactaattgtctctatcctacagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggtgggcatcatttcctttctcttgatccaggctcccaactcccaaagcacactttttaatatatcctgtcatttttaggattcctggcccctgacaaggttgacagtaaattctttgaccccaaatttgcctttaaggaggttgaagttcaggctaagaccgttactgaattggttactaagaagaagccaaaggtgtgttttggggaatggggtcactcttgggtcctggaactctagggaggttgggcctggtgggtcctacaggtaccttagaagggcctgaccaagcttctctcttttccttcctaaggctgaaggctatgctgagggtgacctcactctctatcaccgtacctcagtcactgacttcctccgagctgccaaccctgttgacttcctctccaaggccagcgaagtgagtctccagccttgagggacatgaggtagccccagaaacatggcctgaggatctcccctgacacctttccatcctcccaaacagatcatggtagatgatgaagagttggcacagcatccagctaccactgaggacatacgggtgtgctgtcaggacatcagagtgttggggcgcaaggagctcaggtatggagtggggtaggcacgggggccaggagccctggaggcagggaaaggccatgatgttggacctctgggaagaggatattgctgtgctaaaggtttgggatgggggcctgagccttttgatttatgtagccgaagcccgaaaggtgggtagtgagcctaaaacagaagggggcggggacaaagagggagatggcaagatcagtaatagtatctctggggcaggtcgctactaaactggagaacaaaacttcggcgatatgtggccaagaagctgaaagaacaagcaaaggcactggacatcaggtgaggagagaacgcagcgaggcaggtgtggactgggtgtccaggggaaaagtctgggaaaataacccaactcttgggactgttttgccagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggtgaaaggagctggggtagagcttggagttccccaacgcagggactgtgtgaagatgggagaagaaaatgcaaggcatggatagaaactttggagctgggccggttttactccctcaatccaccccctcaggaagaaaaagaagctgttgcgtgagcagagaaagcagcgggagcgtgtggagctgaagatggatctgcctggggtttccattgcagacgagggggagactggcatgttctccttgagcaccatccggggtcaccaggtgaggcggcattgggggtgcaggtttaggagacagaaggatctgtttgggtgtttggaggtggggggtgttgaatgtctttttaggttgccgaacgataggctgtggttgctgtcttcaccacagggtgccttggtgagtataaggccacaaagaaacataaaccaaaaaggatgagttaggtagatagatgagtgtgatagatttattttttttttttttgagacggagtcttgctctgttgcccaggctggagtgcagtggcacgatctcggcccactgcaagctccaccttccaggttcacaccattctcctgcctcagcctcccgagtagctgggacaacaggcgcctaccaccacgcctggctaattttttgtatttttagtagagacggggtttcaccgtgttagccaggatggtctcgacctcctgacctcgtgatctgcccacctcggcctcccaaagtgctgggattacaggcgtgagccaccgcgcccggctgatagatttattcttgaagaactagaacatcagaaaagaacttaggttatagtagatgctgccaggttacttgagtttcaagcacagatgaatagaggatctccctcagaggggagcagcattctttagttcattgagaccaagtgagcactcgcattagggtacttccactgaatactgaagaacatgtttttcctgacaaaatcagggtcacaaacaaaatgaacttttgtggcttatgtgtgggagtgtcataatcaggtcatctttgttgtacaggagggcagtagagcatggtggccctagagcagacacaggctcaggtttccttcccagctctaccacctggagctttgtgaagtgactgagctgactaccacttatccttgctgcctcagtttcctcatctgtaaaacaataatagaacctacctactagagtttttggtgaggaataaaaaaagataggtgtaatccctcatatgtgataaacactcaagaaatagtagttggagtttttcctttgagacaagatcttgttttgtcacccaggctggagttcagtggtgccatcatgactcactgcagcctcaaactcctggcatcaagcaatcctcctgcctcagcctcccaaaatgctgagattacaggtgtgagccaccatacccagcctagtatctttaccatgaggaaaataaaaggttctgacaattggtttaagtggaacagttttgttggatgtatgttggctgggccccttttattcagtggaaacaaactgtgtagacggtattctcaggagatgattgagatgctgtctgagaataatttttaaaggaaaaccagtgttgtagaatatgttaagatttggtgctatgtgggctgtaggtaccttccttaagacctatttgtgataccactgagacaagacagctgagtgggatagatcagtaacccagcctagaacgggatgttgtaaacaggccattcactaccctggatctgagctttcccatctgtgaaaggataatggatttgccagtgttctttctagtgttgctgagcatagactgaggtgagggacacagaaaaaaaaacagtatatttccttttaaatagtttacctttgtttctgttacacttcagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcggtaaggggcacgtgtgcaccaaagggaatgctgccactctgaggaagtgttagggtgggtactaccagagcctgagtagggcagcaagggctccaggcaatctgggtctctgagccccctactttcctttgggtctacagtatgcgacttactgaagtgcaagatgataaagaggaggaggaggaggagaatccactgctggtaccactggaggaaaaggcagtactgcaggaagaacaagccaacctgtggttctcaaaggtaaggagaggccgggggcaagactgcggggagatgagtcttccttgggagaagggcagctgatgttctcctatcacagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagaggtgagtagttgcagctgagagaagggatggaaaggaagcggtggcttgaaccatttctctaaattgggggttcttaatcttggctgcacatggggagggttaaaaatactgtactgacgatcctgatttaactggtctggggtacagcctgcatggcaggatttttgcaaattccgtgggagtgcggtctgagtagtacagagtggtggaatcactcagagtcctcccctcttcacagctgggaacccctccgtggtaagaagcgaagccgtgggcctaagtcagatgatgacgggtttgagatagtgcctattgaggacccaggtgagagctctgtatgcagtggaatgagaaaagaccactggaagtctcagtattgggaattgagctttgacctttctccttccctctctagcgaaacatcggatactggaccccgaaggccttgctctaggtgctgttattgcctcttccaaaaaggccaagagagacctcatagataactccttcaaccggtaaaggggccataaactcatcaagagtgacccagggtctggtgggtaaatgggtaattttttgtttttgagatggagtctcgctctgttgcccaggctggagtgcaatggcacgatcttggctcactgcagcctgattctccttgaatcgcttgagtcagccttctgagtagctgggattacaggtgccaaccaccacgcccagctaatttttgtatttttagtagagatggggtttcaccatgttggccaggctggtcaaactcctgacctcaggtgatctgcccacctcagcctcccaaagtgcagggattacaggcgtgagccaccgtgcccagtctggtaatttctttagaaagcctggaatgttggatattagacagatgtcctttccactcaggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggagggtaagtgatggggcctccagagattgggtggggtgggggtggggggatggggaagaggtcacctgacaggttcctttgcagatgctgaagaggctggagcagaccaggaagaaggcagaagccgtggtgaacacagtggacatctcagaacgagagaaagtggcacagctgcgaaggtaatgggaggacaccacaaaggtacacagggctaaaagtgcagcagaaagcaagcctctaacctcttctcttcccccctgtagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctgaataaaaccaggataatggaagagttgtcttttctgacagttttaataagcacttccctatctgtccctacactgtgtgcggcactattcttaatatgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgagatagaagacactttaaaagctgttgttgggtttcttgtttaattttaaatttagcaataccatctcaaacctggagcaatcctggaacagttaccaggatcaccttttcccttcaatccttgtggcttctgggaatcttcagagcctgggtctgaaaggtgtttcctacatgtctcagggctggatgcaaacctggctggggacctgagcatcaactcccatttagaatcagacatctcccttccctgcaaatgtctacaactaccaaattgctccccaacagttagctcaatggattgaatttgcagaagccaactcctaaaatggggactgcctggccatacaactaagaaaaagaagtcaatttatagatgcttataaggtgacaccttagtaaaaaatataagctacatacaatataaacctagagtgagttttgtgccctagaagaccctttatcccaagataacctcaacttacccacatgacaactcacctagagccaaaagaagcttcccagctctcactgcttccaaggaccaaaacagcttcccaagaaaacatccgaaaattccttctgatgaaggggtaatgtctccaagctccagctctccactaagggcagggggtccttacactttggaccccaacccagccctgagacacctagttaccaaaatctttctaaaaattaaggacaactgatttcacgctttagcacatcccctctaactgtcccatcgacttttcttgcgtttaggcggctctgggacagcaaagccgtcagctgtcttatctgtcttgctgtccaccttgtccatcttgctgctgtccactttgggttccatcttgggctccatcttgctctcacgattaaaagcttctttcctgctttccccattccgaccatcatttgcaccccggttctccccatgccggcctgcgcttcctccatgtctgttctccccgtgccgatggccatcagtatgacggctgctgctttctggatggcggtatccatctccatggcgaccaccatctccgtgacgtggactatcgctatgccgattgccagtctctccgtgactgtgacggctgctgccccggttctcagtatatctctctcttttcccgttgctgcccccagtcccttctcggctgttattccctgaagctgtgttgttgactccttgggctccggcagacgggtaggtcacaggggcaccactgatgttgccagtattgccaaagcctgggatgcccttggcggcactggtgacggggctgtcaggactgttatggccctgttgtgctgagttagttggaacagaattcaagctccctgcactagtccacccacttgccccagcagcagaacttccagccttctgattacttaaactggctgcaacaaagtgactcttgtactgtgactgaaagagaaagagacatcaggagtaggtaagatagcaagttcaagaaacttgaatatacaacttggcaaatgatgaggtttacagaaactctgtgctatcctggcactgtgagtttagtgtcctgatggccccacagtatggtcccttttgttcttgtgctataaaggaaaacttgtggatctctgtggagagatggacccccagtgttctgaaatgtacttttatagcctgattggctagaataaagcatctatgtatttagcacatttatctgcattcaaaaccaaaaagttctgaaaacttaaaaaaaattttcatactgcaatttaagtttgacagcaaaacctgccttgaactcattctatcgattcaccttagtgtgactatcagtaaattttgcttcagaagtgagttggaggtgggtgcctgggaggtgggcaacacttcaggctgttgggaagggagggaacacacaccctgctgcaggacaacaatcccaggccccaagtgtgactcaaagtagaccagcacaaggggttctctagatcaacttgcatttccaactaagctactgttaggtttatattcaaaatccaagcagcgtgaagaccctaaatctagcatcaagcctaggcgcccagctacaaccaggaaaactaagcccctctgtcactgcccaagagttactgctgaaagtgcttttaatgaaatgcttatttcagacctggaaagctgctttcattgccgttagtcgatctcccatagctcctgtggaaggcttgtaggcctcataattgctcattacattgttatttcctcgatcctaaaaaaataaacacatctatgagaatgaaaaaataagcaggaaagctcactgctatagactaggcctcattatgaaaacccttgaagtgggagctacaaaggaactggatacttttagaaagctgctactgctttgtgagaaaagacacagtgacaatcatttaaaaatgcttatgccctcaacccagaaattctatttctggaaattaaccctattaaacagaaatgcaatcagattatgcccaaagttgatcatgtatttacataaacacttccaattaattaagtaaaaattacgttaaagatgaaaaggccctgaatagcatattgtgtgactgctcaggccctgaatcaagaccatgaagggtctgaatttcggcttgaacacttgtcactgtaaccttaggtgcctcagcattgttatctgtactaacttccattcagttattttgaagattaactgagccaaaacatctgattgcttggaatggtcctggcacatataaagtgctcaataaatattacctattattatgcatcatcatcattattattataatgtgggaacagagtatgtaattacaaagatgccaagtttaatgctccagaaaagtatactggcagctttcttccctggcttggaatcaaggtgacagaaaacaggcagttaagaaaggccaccaaaagggtacatttgttacctggtttgtgagaaaaactagctcccgacttggaaattcctgatccgttcctgagtttaatgacaagatatggctagactttacagtgaccctttggcaacatttacctagcagcaggctttaggccagtgttgaagggcttataaaaccagactgctgggccccaactccagagtttctgattcacaaggtctggggttggggatgagtttgcatgtgctgctggtccagggaccacagtgtgagatcactgctaatctagaataatttcctgagcaagcctagtcaaccaagtacacaaagatgcttcttcaatagaaagttaccataagaatgagcactgcattgactcaaatcagattaaatacaaattcccttctagacagggctttaaactcactgaggctttcctgggtagatgagaatattcctaatgactttcaggacatgagaccaactataaaggcactactgtagtagtctagactcaccatgttctcagagcccaggccaggccgctccctgtagcctaggcctcctccaccaatgttcagcttttttcctttccctcctttgaatcgagatttccgaaaccaggcattctgcattgaacaaaattcaaggttaagtcaagggagggagaaaagaacagaagaagagaacgaggacaaagaggaaattaagtgggaagggggaacttttgcttaattttcagccagcactacgctaagggaggaattttcacaggaaccacagattggtttctctttggtagcataatccaccaaatttgaaaagtggctgagatccttatctaaggcttcctacagtgctccctccctcaaggctctcctggaagggaagttgttcaggtaagcttcaaacccagaggagtaactttggctacttctaacttccttgaggaaaatgagcttatattttatttctcaaaccatgtattattggacgtaaacatttggaacttaaacaactggtatgttcagaagcaaaggaaaaatgctatgtgaagtgaggcttatcagaactgactatagggacagactcccagaaaggatggtagccacacaactgaaaattttatttacccgcagagcgtaaaagttttcattgaacttgaccattgccactcaacatatttactcacattctcttaagaatgcagggcggtggctcacgcctatgaatcccagcactctggaggccgaggtgggcggatcacttgaggccaggagtcaagaccagcctgaccaacatggtgaaaccccgtccctactaaaaatacaaaaattagccaggcatggtggcacatgcctctaatcccagctgcttgggaggctgaggcaggagaactgtttgaaccggagacgcagaggttgcagtgagctgagactgcgccactgcactccagcctgggtgatagagtgtgactccatctcagaaaaaagaaaaaaaaaaaaaaaaaaaaaaagcaaatgtctctgggaaggttaaagttttatctgacaatcacatattaccagcaaaataaagtgcttgagaggtagggcagcaggcttggacaaagtcctgagcacagaaagcctgaggtacaaaaagaaatggaagaaaatgccaaagtcaaaatgtgtcctgttttaaaagtttatttaggactagctctctgtgctcaggagcaggggaggaaacattattctcttctctcctgcagtgcaggtcctttactcctaggaccagaaacttgggcactgccacattgcagctgggttgtaccagttgtgtgagctggcctaggcatttgacaaactcttaacagtttctgctctcagaaagtgttccgaacccatttgtaatttggggacagcatggattcagatgactccaggtttgatttgttagaatgcctcacttagctttagattggagcacacctggaagagggcaatcagtgtggtcagaggtctgagatctctgcaaggaacagttaagaggcaccatacaggctgggcacggtggctcacgcctgtaatcctagcactttgggaggttgaggccgaggcgggcggatcacctgaggtcaggagttcgagaccagcccgaccaacatggcaaaaccccatctctactaaaattacaaaaattggccaggcgtggtggtgggcgcctgtaatcacaactgcttgggaggctaaggcaggagaattgcttgaacccaggaggcagaggttgcagtgagccgagatcgtgccattgcactgcagcctgggcgatagagtgagattctgtctcaaaaaaaaaaggtgggggggcactatactatacacatattgttttaaaggcatcacacatttttagcctcccagaagaaaaattttgtgggggaagagcagtaaggagaatagtaaccatctttgagattaaatttactcctaagtgtgctatggggtagaaattacagcgacagattttagcacaaaggaatagcttttcaaaacagatgctgttgaaagaagaagaccagataagactagatgaattttagtatctcacaattcctatctgtacctcataagccccacatcctcctagccacccaactttcttgtcaagtttttatgttatctgttccaggactgctaaaatgtcttggtcttataaccaggagcaattgaaagtgtgcccagcccctcacctgcattgccagatctaggagttccttagaaacgtgttgattggctccttccaagttccggaccaggtcaccagcaaaattgctgtccttgggagtgagtagggtataggccacacctttctcacccgctcttcctgtgcggccaatcctatgcgtgtgggtatcaatgtctcgtgccacatcatagttaatgacagtcttaattgaaggaatgtccagaccacgggctgaaataaaaagcaaccaaattcttttattcttcatctgtagtcagaagatcaaagtaaccagaaatgctagtgctaataagccacatttcctttatctaggcaaagcgcatgggtttggtgagctgagatacaggcatgttaagtcaccaccacagattctatgatgttaggccttctagtgtaagggacttttattttttagagacggagtcttgctctgttgccagacgggagtgcagtgccatgatctcggctcactgcaacctccgactccctggttcaagcaattctcctgcctcagctttccaagtagctgggattataggcacgcgccaccacacccagctaatttttgtatttttagtagagacggggtttcactatgttggccaggatggtctcgatctcctgacctcaggtgatccgcccgcctccacctcccaaaatgctgggattacaggtgtgagccaccgtgcccgactgggacttttatcttttgcatcagtaatctgccatgccctcttctcttgcactgggaatatatatttaaaatgtgtcatgaagctgagaagttctctcctttctaggaaaaaatatcagtgtttaagggtagttattaaaacttgacagaacaaatccagaaattatattccaaaaactgttctcatcctgagttaagttgcccaactaagctgtgtatagtagatcaatgtaagggtaaggtatctactatattcagacatacaataagggcattcactgccttttttcccagagtgacttctagctgcagggattctttgattagagagaaatactaagtgaaaagtggtatctagagctccagactgtgatccctgtgctgaactgctgcttccttgggggtttgggaggggatggccagccaggccaacagtctttccatcagcctgctcagatattataggtcttatgtagtaagacagagtacccttatagcctaggaacttaatgttgttgaaaaattcatactctacctgcaacatctgtggccaccaggactgggatgtcctttttcttaaagtctgaaatgaccttgtttctctcactctgatccatatccccatggagcagcccaagattatgaccctcctgtttaaggttattcgctagctcttcagcattggcttttttagtaacaaagaggaggacactccctgaagaggtaaattctaccagacgccgggtaagccagttccatttactaggtccagaatggagaatctccacaatctgtgtcacatcttcatttgcctgagaaggaagaaatgaaacagatgattgtgacattggagccacagggcacctgaacaaggactaggcattatatttctacctgcatcgagaagaccttgaacaatcccagttctccttgggccttcagcaagtcaagtgcagctcaaaactcacctctcctttccaatcaccttgctctccacctggtgtacatacctaatttgtatgccccactactttgtagagctttccttaacaataaccatggcaagcaactgaaggattctctaagcagccataactgaattccaagtcccaattcagagtaatttttcacatagcgcatatgtacaggtaagaaatgaaacctgattttttccaggccttccaggtcaccctttccctcctgcgtaggcccctaccacaataattaaaacgtcagttccaacctaatacgctgatgcttccaggcacatctttttgtctctttgaagcctttttaaaacaattgtaagttttgagacattcaataaaacaaaaaaaacacaaaatgaacaaaatcaactcatacccatcacctagcttcaatgattcccaacattttgccagtcttgttacgtctatccccacaacttgcaaaatacccaatctcaagcatgttgcatctataaacataacatcttttttttttatctcaatagtgagaaattaattctgtgttccataatatgagaaataaacccattaaggtcccatccagccctgcttagggttacctctccaatatctccctgcaccactcgaatagggtcgatcaggatgtctctggccaacttttcaatcttcttccgaaaagttgcactaaataagagagctaaaaggtaagataaattctgttagagaaacaatatgatatctttatgcatacccattaagcttctttggcattcaggattattcagtttttttacataagctcacctgaactttaaatttagtttagaaactgattcactagggaaagatttgctcttattctatttttattacatttttagttaagacaagttgtcagtatggttcagaaaaagactcttgatttcaaatcagcagatctgtactgtacactgcttctacccactgataaaactgtataatttagggcagtttatttaatttctgatccttggttttatcatctataaaaaggaacaagttatatctagtgctaagatcctgtccagctcagataaactcattacctcccttattatggttctcaccaacagacacaagatcatttttacttccataactctgagtgcttataaaataaataagtgccctttttagtacaaatttggtttaacaaaggtgcttcatacatactctgcctgtcaggacgaacatgacttgctatggatcgaacttggtactctgcaagaaacagaacaataaaattattataacctgaaatacagtttgggaagcctggaaaaagccatattagtaaaagtcttcataagaagttgtaagaattaagaaaattagaaaccccaggccaggcacagtggctcatgcctgtaatcctagcactttcggaggccgaagcaggcggatcacttgaggtcaggagttcgcagcctggtcaacacagctatctctactaaaaataccaaaaaaaaaaaaaaaaaaaaatagccaggctgtggggtaggtgcctatcaccccaactactcaggaggctgaggcagaagaatcgcttgaaactggaaggaggaagttgcagtgagatcgcaccgctgcactgcagcctgggcaacaaaagcaaaactctgtctcaagaaaaaagaagctcctaaacatatcattcagcataaaagtgaaaaattttccctccatccaactgggctaggtctagcagtgttccaatcagtaaagacagctacgaggataggaaagcaaagggcctcgaatgatctgacattcatctacccaagaacacagaccttaacctctatgatcaaaggcatatggataaaaatgaagacagagaaaatattccccttatatacaaaggcactttgaaatttcctcaacccaataaaacctaacatacttttccagagaaaactcctaaaaatgttcatcttagctatatttctatagtctaaccccatccaggagtatttttagcttctctcatgctgaaaaaacagtctagaaagacatggaaaaaaaactagtatcatgaggatggggacagaagaaactggtattcaaggcataccaaatcccatgtcaaacattcgatctgcttcatcaaacacaaggtaagagactctttgaagattggtagctttctttttcacatgatctatcagtcgaccctataagatcaacaaaatgaacagtaagtataattaaaggcattcacagggactttctaagcagttgcactcctggcaaaagtgctaattctctagtctcagactgtaatagatactggtccaacagccacataccttatgcactacttagctcaaaggaacagaaattttgaaaactcaatcggcatcttcatttacactgtgatttaaattctgtgggaaagtggccagaagcagtttttgaggcattctaaagtgacctgatttaaagcataatgacaggtttcaatgtttaaactacactcttctaggctattctgaccatatgtatctttctgattcttgatgaacttggcaatcattttgtgggagagtataagaaaaactatttgacatagaggggaatttgtagctactagcctatatgtcacagagactctcactgaactgctaatttagccaccaatcaaaattaaaaccacagcctgccgttcatcagtatattttcaaccctgcttttaccacactttaggggaaattctctgcaaaactaatcatgttttccataccgagggaggctgagaagccatttaaacacaaggcatacttactggggtacacacaacaatctctgccccctcctgaagggccttggcctgctcccacatactccctcctccatatacggccactgatcgaagattatatgcttttccaaaccgcttacattctgcatggatctacaaagttgtgaataatatattaacaaactgtgacactaacaaatacctgtcacaacccaaacgaagttctgaaaaacagaatgtgatgtcataaaaaatcgaaacctagaacatactttaaaaccacgattttattcataaaggtataaatgaatggaataccattattgcatctcaacagattatctaaaatcttttattcattttacccccttctcttcctgatcctgtcactgcttttctaccaagataaaatgaactcatcctacagaaaaactgtcagcttataatacaaacaatccccatatcacaataggcttttcctcttaaaaaaagtagttctggccgggcacagtggctcacacctgtaatcccagcactgtgggaggccaaggcaagcagatcacttgaggtcaggagtttgagaccagcctggccaacatggtgaaaccccgtctctactaaaaataaaaaaattagccaggtgtggtggcgtgtgcccgtgatcccagcctctcggctgaggcaggagaattgcttgaaactgggaggtggaggttgcagtgagctgagatcacaccactgcactccagcctgggcaaaagagtgagactctgtctcaaaaaaagcaaataaataaaaataaataaaaacagtagtttttaggggaaaatatgtatttggttatatagaaaatatttaacacataatactttccaaaagtttcctggtagcacaacactgtgaatatacttaatgccactgaactgtacattaaaaatggttaagataatcaattttgtgtgtatcttatcacaattaaaaaaaaaagtttcctggtcattctacctcacttgactggctggtcccttgctagtccacatatggaaggaggcattctatagaaagcacatacctgctggcaaagctccctggtaggacacacaatcactgcaattggtccatcacctggttccaactccttctggtccattatatgaatcaacatgggccaaatgaaggctgcagttttcccactacctgttttggcaataccaatcatgtctctaccacttaatgccacaggcacaccctggagaaaaagtaaaatataaccactctaaaatttcaattctaaagatgtactgaagcaaatcctggggaatgataaatgactactaacatttttatttgcaatggaacaaaacatacctggtgctatgcatactggttgtgaaatagaaatatcaatatccaacattctcattaacttcttgatttataggaaatgacatcattctcattacgtggatatcagccaccacttacagaacagaaacaactccattttgtttaaaatacagaaatgaaaaatcaaggccgggcagtggctcacgcctgtaatcccagcactttgggaggccgaggtgggcaggttccctgagctcaggagctcgagaccagcctgggcaacacggtgaaaccctatctcaactaaaatacaaaaaattagccaggtgtgctggcgtgcgcctgtaatcccacctacttgggaggccgaggcaggagaattgcttgaacctgggaggcagagattgcagtgagccaagatcgcgccactgcactccagcttggacaacagagtgagactctgtccccaaaaaaaacaaaaacaaaaacaaaacagaaaaattgcaatttataatgaagggttgctaaaattttaaaaattttccccccttaagaaggtacagactatctcattcatatacagaaaatgagaatgttctgcataagaataaataaatcccatatataaatgggaaaaagaagctaaaactttcagtaatgaatgagaattttcaagtgacgaacgaaggaattctagtcattgacagtgctaaatttgtctatatacgaacctttttggttaggtttaggcctaataaattattttcttcatatcatattttcaacatacgtatcagatacaaaagaatatttgtcagccatttagtgacttcttaagagtgataaatacctctatccttatcaacaaggttctacactaaacactgttttactgctgtgatttgtttttaaattaatatagtcatgaaagactaccctactttatttttctttcattatgttttacttacctggcactgtattggagtgggctgtgtgtattcagatttccgaatctggtgcataagttgttcgtcaaacccaaaatgagcaaagctacttcctggtctaggaggtgcagcaccagagacctagagatagagacaactccccagaatgacttgtacttcaacattaacagcatttgaagttcaacaatacttacctggatctagcattttagctggagtatgaagtaaaaatacaagtctgtaagccaaaatcatacaatgaaaaggaaaaacctcaaatggtaacaaatataaacctcatattaaaaactccatgataaatattcccaagataattgtcatacaattttaaatgattaaaaatttcttaactcaaaattaattttctcataacaaataaaacggaaaaaaaattgttcaatgaattgggaagccataactgttcttttgccattttgcattaagtattaaccagatggtagaaaaaaattaatgtatcttactcttgaaatgaaaattccaagtgggctccaaataagacaagtctacacatgctggctaccaagatataatctactgcctccattttcagttatgcttgatgaattaaagtctcacttagtgatggtccagccactgtcaagccctgttcaaactgcacctaggtgaagaatggggcttataatctccattttgtcccccaaagtggtaacctttcaatgcttctctggtgatgttgatatttccaatcaggatttcaggggttttacttaaaatttttcttgggtcactggggagatgagtaacctcttggaaaacagacaagtgtacacacacaaatacacacccctcctggaaaacaggagtttaaacatcgtgtagcaactgataaggtgcacacaggcgagaaagttgtctatattagagtagatagcatagcatattttttctgtgtgtttcatttaccatctatcagcaccttaaaccaatgtagccaatgtgcagcccaaaactttctggtaggcagtttaaaccattctgaaattagtacatgcatatttttaaaaggtattagtttattctaatttttaaaataaagcatactatatgtaatttgacagacaagtttatcttcatttcaaaatattctaagatatcatctgttaacatctattccttttgtttcctcttcctttagatggggactcccacccttcatcactagcccatccagcacagaacatataaaactgactgaaatatgaaacaagaaaatgatcctatcctaaaacagcatctagaagactaaaacaatcaaattaagagacatgaacagaagggatataataattactctggcaaagacagttcagagaccattagaaaagaaattcaaggttattagtttagataaccaataatactaaatctggactaattaacattaatattaagaatattgagcttaatgatgcttacccgaagattgagcttatgccggagatctattaactgctgtggagtgaggttggttatctcttcatgctcattgtaaaagtttttttcaaatggtg

SEQ ID NO: 6303 - DNA, 15500 bp, Homo sapiens
caaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccaggtgagcaaggaggacgcgagcggacgggggcgagaggcgctgcgagggcgcccgggccggcggctgaaggggcctcgagtgagggccctggggaatgcatgaggaactccgggagacggtggagggcgggccgggaccctcgggctgcggcgggtcgcggtggagaagtgggaaggggaagcaggttctgcagcggagggctggaagcagctgggaggcctgggggcttccgcggcacagggattccgagtgactgggagatggaggagtttggggagccagtgaattgtggcgggtgggttgagaagtctagggtaggagggctggaaagtgatgagaaagtttgggaaagggccctcgctgagaaaccggggttaccctgcatcggccttggtcccagtccaagtctgccctgttttttctgattgggaactggcggagctctagcgtgtctgagatggctcccggctgctaataaggaggaaggagcctggcttcccacgggcacgggacgctgaggctagggccaggggattccagcttgtgcacgggcggactttactcctgaggcagggccaggcgccttcgctgggaggactccagcttagaccagagacggtggtggcctggcctgaggggaggcccagcccagtcacaggccggctctcttctgggctttctgcctcctgtcatcgtgtccgggagttgattagtctggacgtgcagagtggagccctgctggtctggggccggaggagtctgcgagagttgcttcaaagagtgctgtcctgacccctttggggttttgagagctgctcagattgcagcttcaaaagcccttgcaaagcagcgacttctgctcagtgtgtgaggacctcagcctgaccctgccagtgctctagtctgctgttcaggttgccccagagggcttggaaactgtgcccatctgccttgtcaccctctctgcatttttatttggccttcaggttctaactccaccacgtccgaagccatgtgcccaagcatttgacactggcttcttgctcatctacgggtttgctgtgggcttcctctgttttcgactcatgtctccaggcagaggtccttagggatcctcgtggagtatacacagcctacctgccccactgggccctcacttctaaggagatggcttaactagggacagtgactggatttttttttccttcttactcctcattcttcctcctttctcaagagaaaagagagtctgggtatgggcagagacagacctggtcccagggattccagctggggctcatctctcccaccttgctgtccccgttggggattcatgggcccagggtgttgctgagggctccctgcatcattcattgtagcccttgggcctgcccactgagacctggcctgggcaccatctgtgggcctttggccttggaaggacctggaacagacaagccgctccagtttccttggcatgcaagccataggaaatgtgcccttgggacagcccctgagaggatggattccacatgttttggtggggggtggccttgggcctgtggcaaggccaagctggctggctggttaggcctgggctgctagctgtgcggaagtaggagatggccctgagtctgggtttcccatcccactagctttcctcctcctggcaggagaggtagatgggaaggagaacccagccagctaactttggctgagtttgaagaggatcctatttgccttctttccaagtccagttgtatgactgccaggagaagggacttgagatctgggaaacaaaggggttcctgtctgttagggctcatgagatgcacttgaaaagtgagaatttgaggcccaagctgagcaaatagttgaaagaagggaagtgatgacctcccttcctccagagggtggttctagctgtggatcacagttaacagaggaacctaaaaaaagaaaaagaaaagaaaaaaacctccagggcaggatatggtgggctcacacctgtaatcctagcactttgggaggcccagacagaaggattacttgagaccaggagttcaagaccagcctaagcaacatagtgagaccatcatctcttaaaaaaaaaaaaaaaaatttagccaagcatggtggtgtgcgcttatggtcccagctactcaggatgctgtggcaggaggattgcttgagtccaggagttcaaggctgcattgagctatgatcctgccactgcactccagcctgggcaacaaaataacaaaaacctcagattgctgggttcactccagagagttcaaaaagttcaaaaaaaaaattttttttttctgatacggagtctcactctgtcgcccaggctggagtgcagtgacatgatctcagctcactgcaacctccgcctcccaggttcaaacaatcctctgcctcaagcctcctgagtagctgggattacaggcgcccaccaccacgcccggctaatttttttgtatttttagtagagacgaggtttcaccatcttggccaggatggtctcgaactcctgaccttgtgatccacccgcctcggcctcccaaagtgctgggattataggcgtgagccactgcacccggcctcaaaatcctttttactcatgggagagtgggtggtatgttccccaactgaggccctcaggcccaggttccaggagcatcagggccacatttggggcagggcaaagcacgctcaccggagccctggattcctcatctggggttcaggggattgatccaggcctacctggtcctgctgcaggcagggagttagggaggctcagagtgctggactgcttttttttttttctttaactcctgagttgtttttttttgtttgttttgttttgttttgttttttgaagtgggaggagttgctagcgcctataagccctatggagcttggcaaggctcagctgggacttgaactataagcagccttcccctggggccctgagtgagccaggggctctgggcccaggaaacctggagcagatgtctgggtggagcctattccagaccctgcctatgaggccttgtcttgggacttcctgttaccggagcacctgcccaggagggatgggtggtgctgcaggttttgtgaacactgcagcagggagcttcctggggaccacagggccctcgctcacctctgcaggacccactgcttcagttcttccctgtctttgtctcaggcactaggaaaaactagtctgggatgtctgggcctgggcttacagctgtagccacacttagtttttttctataatctcaggccagagaaagaacaatctttaaggcagagaaagaggctgtcttttgcctttcaacagctctgattaatctcttcctgatgcagagagactttggcaggactcccaaagccccagagccccccactttgaactttttattctcccaaacacttccgtcccaccctgctcctcctctccccatcctcacgtctgtgggtcatgtttctttccatctccgcatctggtcaagaatctgaccctctgtgttgggaacatgggtttagtgcgggatgaagaggttggggaagaatctcatctccatgatgctggggtgggggagggtcctttgatttggtacaagtctccaccctgccgggcttggttggctggttgtgctcgttgcataatctgggccctggggccagccctgtgaagctgccagggacagtgtgtgcaaggcagagctgccaaacaggccttgcaggcagcagccatggggaggcgggtgggggtggaggtgactcccagatgggctccacagaaatgtcagggagcaaggcctcaggtgggaaatccttctgcaggcatctaaagaagctatttctgtctcccactttcctgctgctcagcctgggcctctatccttgcctcccaggataatcttagcccccttctccagcttgggattgccagggctacacggagccagagccagtcctggctgccaggtggtgcctggaccactggcagagtccaggtgctagctgctctctttcccacaggccacccaggagccatagcttcccttctggggtcttctgtcataggggtagtagttgggcagtagggaggtaagaggagggtccagttctgggctgtgggtgggggctatgtgataccagactacagggtacagggtccctgtaccctgcccgaggccacccccaccagctggtacacgttccaagccatcctgttgcagccctgctcacctggggtgctgctgcctaccagacccctttctccctcggccacagaggatggggattggggctctgcgccattggcctactcatactatagtacactcctctgcctggcagtgacactgcccctgtgcctctcagccatgcttcttcttcatgatgggagaaagagaaggagggcagggcttggcaggactgtctgagagaatagggaccagcttgcccagggaatagggcacagcatgctggggctggaaggtagcaatgggccctgaaaagctccccaaggcccttccctctgcaggcaggaccctcctcccagcccaggttctggcaggcctcattcgctggcatggctgccagggcggttgcagggggcagggcaggtgtggtttacactctgtgctcaggcgcccactcccctttgttcctggggctccagcagggctctggtgtgctgctcaggccctacctggctgacgagagggatggagggcatgggctatgggtcccggagggccttgcccctgacctatgcacccccgttggctcacttcccccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggtaagagcatcctgcttctctcactctgcctaactcagctctggtggtagcagagggtttccttctatcttaagagctttggtgactgaggatgactccaggctctcctgggggagagggtcctggagactggaggggcgttatgggagtgagtgtccttttttggaccattgacctcttaagtgggtttctgtcctccccaggttaaagaggaggaagatggcagataaggttctacctcagcgagtaagtgttaagaggacacctgggaggcctgcccagtggccaccttggggtgggtgtccatctctctcaaagctgggctgcagcaggaagggaggaaagagccaggctttggctgaagcaagctgatgagcttctgctaccttccttcagatccgggagcttgttccagagtctcaggcgtacatggatctcttggcttttgagcggaagctggaccagaccattgctcgcaagcggatggagatccaggaggccatcaaaaagcctctgacagtatgtgtggccctgaccacctctagccttcccaggtttccttgccttccacccccttgttttccaggggccaagcaagttgggctagagccgggtttttcacatgcaggatgcagcccactagtagagtacgaactcagttgaatgtgttggggccagtatgttttaaatgaatatatgacagtagaaaatcttaaaatacttcacagtagtacttaccatagtagtaaatggattctttcatgacatttttgtttctgataaatagatatgcagaccttgggtcataattgaaaatgtaaatcttatgggtggtggtcaaaagtttgaaaaccactagactaggggataaaggtagttcctttctccttccccttccccatccatagagaaattttcttttttttttttttttttttttctgagatggagtctcgctctttcacctaagctggagtgcagtgttgcgatctcggctcactgcaaccttcgcatcccaggttcaagtaattcttcttgcctcagcctcccgagtaactaggattacagatgcctgtcaccacgcccggctaatttttgtatttttagtatcgccatgttacccaggctggtctcgaactcctgactgcctcggcctcccaaagtgctgagattacaggcgtgagccactgcacccagccgagaagcttttcttaataataatgtagaacagtcccgagtggtgaagcctttccaggggactaggatattttggagccgtgatgggtgtttgggtttcatgtaagatgtgagccagagactggctgcgtgttactccatcatgccgtagcaccagtcccactgtgctggcattgttggtgatgcatctctttccccataaaatggtgagttccggccaggtgcggtggctcacacctgtaatctcagcactttaggaggccgaagtgggcagatcacctgaggtcaggagtttgagaccagcatggccaacatgttgaaataccatctttacaaaaacacaaaaaattagctgggcatggtggtgcgcacctgtagtcccagctacatgggagactgaggcaagagaatcgcttgaacctgggagtcagaggttgcaagtgagctgagatcgcgccactgcactccagcctgggtgacagagtgagaccatgtctaaaaaaaaaaaaggctgggactgggacttactacttctgattcccagtacctgacaaggtgcctggctggctcatggtgctcagtactgattgttgaatggttcatatgagaagatgcggtagcactgtgtcccagcatcttggtccacctccagttgtgattgcctttctctctttagcaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatgtgagttggggagggaggttctggagggaaggaggcctgtgtgggtttaagactgagaccaaggagtttgatactagcctgagcagcagagccagaccccatctctacaaaaaatttaaaaattagctgggtgcggtggcatgcacctgtagtcccagctactcataaggctgatgcaggaggatggcttgagcccaggaggtcgagcttcagtgagttatgatcacaccactgcacttcagcctgggtgacagagtgagattgtgtctcagaaaaaaaaagactgggccagacacttgggcgctcccagagaagtcctgccatagggaggggggcgctgctccaagcccgttggaggttgatttgtgtggttattacagtgttcctgcagatggcagtcgagtgtctcgaggaagtccctcgtgggctgcaagagggcaccatttccctgcctccagtctgcccagagtcctgcttccatccttcagggcccaggaatcttcagtatccggagctccagggctgaaatggggcttctctttcttgggatttagcatagcttgagatttgagagctcagcagcaccatctcacacccctttccatccccagcctagcaaacagaagaggaagttttcttcattctttaagagcctcgtcattgagctggacaaggagctgtacgggcctgacaatcacctggtggaggtgagagtgggcctggggcaaaagcaggctgatgtgcaggtttggcagggaaatggcctcagggcccttgggaggccctgtgttcacgcccacccccttggtgataagccatgcttccctccctgccagtggcaccggatgcccaccacccaggagacagatggcttccaagtaaaacggcctggagacctcaacgtcaagtgcaccctcctgctcatgctggatcatcaggtgacagagaccctggggtcatttctgggcccacagggacccctcaggaggggagctggttcctagaaacccttcctgtccctgccctattttcccactgttctactataagaacccgttctgactcccctccatccaactccagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccaggttagccagatgccagcccccgttttctcagcccttgctttgccttgcctgctgggctactccttggccacagcctgcagactgctgccctcactggtcctggaatggtccactccactgtgcccacaagccaacgctgagcctttcgtatttcctccagatcttcagttgtggccgactccgtttctccgagattcccatgaagctggcagggttgctgcagcatccagaccccattgtcatcaaccatgtcattaggtaaatgcaaggagggggacaggaaggctcttctaagagcagattcacccttggcttgaactaaagccaaagaaagcatcaggtttctttttccctgagtgtgtgcagagaatgggccccagatttggcccaggtgggcaggatgaagtcagctatgtgccttccctccccatgtgctgcctgcagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaaggtgggccctctggctccacagcttcctctggggcccaggattggggtgggctggctctgtccagcatttccatacatgtagcacctggaggacgggatgggaactctggctcagttgcttgcatgtaagctttgggggcacagtctgacacaggtaccctctccagatccatgagaccattgagtccatcaaccagctgaagacccagagagatttcatgctcagttttagcaccgacccccaggacttcatccaggaatggctccgttcccagcgccgagacctcaaggtgtagtcctctttcccgaggggactcctatgtaaagctctgggtgatttttacccacagcagttcccagggtggattagcccaggggtggggattatgctatggctttcctcctggctctttgcagatcatcactgatgtgattggaaatcctgaggaggagagacgagctgctttctaccaccagccctgggcccaggaagcagtaggcaggcacatctttgccaaggtgaggctctgccctgttttccctcctttggccgtgagtagcaaaggcctgagccacttggtttctcccttctccaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattggtggtgcctggacctggtccttgaacagcacagccctcattaacagactggagtcctagaggacttggcccacagagctttattggagagatacacacaaaggctgtccactcacttccataatttcttgatggacatgtttttctcactgtccttctgcatgacctaggggtgggagagagaatgaacattaagttacgaacacacacatgccctagcccactgccccagagccaccactggcaaaggcacaaagatggaggcctataccttggctactgccatctcaaagtcctcctgagtgacatggactcgccgttctcgcagggcatacatgccagcttctgtgcacacgccctgaacaggaaaaggaaattgaggccccactgctgtgcccctcatctgtggcccttgagcccagagcttcctgcctctgccctgttttcagtgggtactccaattaccttcacttcagcccctgatgctcctggcatgagctcagcaatttttctcaggttgatcccccgggtcaggttcatcttccgagaatgaatcttcaaaatgtccagccgggcctggagatggcaaggaaaagcctgagccccacaccccacccccacagccagagccactttgcacagtgtccatcacaaacctcctcattggggggtgggaattcaatttttctgtcaatgcgccctgggcgaagcagtgccgagtccaggatatcaatcctattagtagccatgataacctgagcagagaaagcaagtggggatcagctaaacctcttcctcagcctgcgtggcacccaggccttccctgggcccatcccaaggatgctaccaccttaccttgatgttcttggtggcctcaaagccgtcgagctggttgagcaactccagcatcgtgcgctgcacttcactgtcccctccagaacccccctccagccgcgaggagccgatggagtcgatttcgtccatgaagatgatagatggagcatgttcccgtgccatgacaaacagctccctcaccattcttgcccctgtgtggaggccgagctggtgttagggagcttattagcttattagctctctaaccccctacccctacctcttgcttctcacattgctagccatggttaccttcccctatgaatttctgtaccagttcagagccagagacacgaataaaggtacagtccgtatgatgagccacagcccgggccaacagtgtcttcccagtgcctggaggtccatacagcagcactccctacaggggaacagcaggactcagggcagaaagctacacccctcatttcattcagtgaacatttaccgagtgctgggtcccttgctagatgttagggatacaaaaaaaaaaaaggaacatcaaggtcccttctatccaaaccacctcaccgccctaggaacacttccccagccactcttttcagggggagggccagcccaagcaagatgcagcctatcccggtgcctccccaacccctgcagtagggctggctggggcaggaggagtaagtacagcttggccctctcagagaagccctgctcctcaccttgggctgagcaatgcccagtgcttcgaagagctcaggatgcttaacaggcagctcgatcacttctttgatctccttgatctgtttgtccagtccaccaatcatctcataagttgaatctggtactttctccaccatcatcagtgacactaatgggtctaccttgttgggcaggatcttgtgcagagtgtagctgtcattccttagagccacccggcaattgggtgtcacctgggtgaagggggcgagtttcagaagtggtacagtaagagctgaccccaccaccaccaccacctcacctgctacactcacatcattgatgtcaatgtttttgtccacgtctacaacaaatttaccttcaggatgtacctaaagaaacaagggctcatgaccttccttgacagccaccaaatcactaatcctacccaggaagacctatgagaatcccacaataccttgacagaacacagaaccctgtctcccgaggctacacacaaaggggtgggaatgcagtggagaccgagctggtccctggggtcatgctgcttttaccttgaccaacactttcttcttatccatggcccggactacttcccccacataggagccctgctcctgcagcagctgtagctcctcccgcaataggcgaactagatggcaaacagacacagtggtcacctagctactcctttggagtctccaggacccaattctacgtgcatgagctaagcatcactcttattaaaggaaggccaaaggtcaaaattcatgtatttaaggaggctacaatagggctcaggaaaaagagatgcatgtgaaactactagatgatgacagggagaaaacagtaagcactgctgtgaagacacagtgcagggagataaggacagacctcagacaaactgcccacatgcggcttcccatctttctccactcacctttagcatttagttcgttcctctgtgcctgcagcctccggaggttttggctcttatcattcacaatcagctgtggcagacaagagacaaattccattattcaagggcaggagacaggaggaggtaggatcttggccaagacctcacaggtctgaatgagctgagggaagggcacagggcacctgcatgttgtttcagattctccagtatgatcctaatgaccctgccctgtccttcaagagtccctctggaccttacagcagccatcaaagaaggctgcttgtccaatactggtccaggagtaacagaatctaatggagaaaagttacagctggctcatgtaacaccaaatttcttgcaggaaggcaacaacacctggtggaaagattgttaggtgagaaacctgagttctagcccagccgctgtcaatcaaaagcaaagtaaaggtaagacaatctatttttaaaaatctagatctgttaccaaacggcacatgggtatagcatcagctaccctgcttcaagactactaaggtgaacgaataaaaacacatgaaaaagcattcaaaaatggtaaactaaacataatacctgcaaatgcacttggaattcagaattgtcttttgtggctttcccccatccaatttatattacagttgacacttgaacaacgcagggggttagggtgaaattgaaaatccatggacctgtccaaagttaaactactaacagcctaccgtaacagtataacgtaacactaacagactactgtttatgttgtctgtaaggcttactactggaagccataccttactgctggaagccttactggtaacacaaacatttgattaacaacataaacggtcctttttctatggtttagcgctttaggctagggctctgggttgcccaatttctttcattcagtctctatggaattagcattgtccagatccctcaatgatgcccttcctcacattctcacttcaccctcacccaacctcttggtgataaatttcaactcctgagcttatgtttcccttttataagaatccttttcattcgggcttcttccaaaagggttgacctttggctagaggtacctttactattaagatttgactcgaagatgtgtaacaaactgtgaacactaagaccctcaaagagatgggactggaggagaacaagagattgcttacttctgatacatacaccctactagctaagaaacaaacaagaaaggagaagcagcagcttcttccactgcactcccaaaggaattagatggatttgtggaagtccgtttccatcccccatcatcacccttcctagctccctctggagtccgtcctcacctggagttcttcaatcttggacagataatattggcggagtccgctgcctgccttcccctcctccagctccatctgaagacacagagtgagtcttaaacgacaggttaaacatccgagggggtaaagccacttgcagggcactttgaataaggcttgacaccaggtagctttgcgtagtagaaaaagtttggacttcggaggctcaggatctgggttctaatccctccctcccttggaaccctccattttcccaggactaaaataaaagaatgggaacgccgcctacctcatacgacttttaggaggaccgagaggcgatatgatatagacggggggcgctttgcactgcgtgaagtgctctacaagcccgaggtgtcagtactgacgaaggagccagcggaacggagccaaaggactggcgtcccgtctcctgcgacccgtgggccggccattcccgcgcccatcgcttccctcactcactccgcttctaccgcgtcttcctctcccagccttgccctgactcaccgagggcggcgctgacacagcagatccggtcgcaggcagcgtccagcatggactggtccaggcacctccgacccacccgacgctcctgccccggcccgctctccactcagatcacgctcgctccgcacccagccccgtaacctgccgggccgccactgcacccgccatacctgctctggtccgtcaagcgccatcttctctcttcagcagagaccgccggcatccgagccgtcttggcgcgcaagcgc

SEQ ID NO: 6304 - DNA, 626 bp, Homo sapiens
tccactttctgaagtttcagttatggtcaacagtggtccaaaaatattaaatggaaaacttcagaaataaacagttcataagttttaaattacatgctttctgagtagcatgatgaaatcttgtttcaacctgcttgggacatgaattatccctttgtccatcatatgcacgttgtatatgttactcacccgatagtcacttagcagctgtcttgattattaggttgactctcgtggtattgcagtgcttgtgttcagttcaataaagttaaggttcaataaagttaaaataaaggttcaataaagttaacctttattttacgtaatgaccctagggcacaagaatagtgatgatggcatattgtcatgattttttttattatttaatatcttattgtgcctaatttacaaattagactttctcataggtgtgtatatttaggaaaaaacatagtacgtgtaaggttcagtactatctgcggtttcaggcatccactggggttctgggaacatattccctgtggataaagggggactactatagtgaatttctattttcccttgtatatgcagtttcttttgaatgcctcagtccttgatgtttggctcctaaaaaaaaaggaaaa

SEQ ID NO: 6305 - DNA, 516 bp, Homo sapiens
cagtatactttgagagcttcataatagttgtatgagatagattctaccagcgtaagtgttctctgggtatacagactcattcttggtgctttctactctactgtcatccaagaatcctctaacttaatcatggattcttcgtatctcacaacacatcttgtctttccatttactcgttttattttagatcctttatggaattatagttttctttatgtagagcctatacatttatagttttgttattctttgttacttatagcttttttgtttgctattgaaacgtgaccttccattataagtcgcatattatctgcatataaaaagtgattgacttcacatactttgtaaatggcagccttaagtgaatttactggtttttttggacagcattttagtattttttccgaagatggccatagtatctgcagttaatgatgactttctcacctcttctgaaatatttgtacctttatcttcttgtgcagttggattggctagtgcttccagtattaa

SEQ ID NO: 6306 - DNA, 176 bp, Homo sapiens
tttgtttaacagatctaccatcgggtctttttcagggacaatttgttagtttattttctttcttttagtgggccatatttttctgtttctttgtataccttgtgacttttttgttgaaaactggatgcttaaatttaatttaatgtggtaattctggaaattaggtagtatccctt

SEQ ID NO: 6307 - DNA, 1121 bp, Homo sapiens
tttttttgtatttttagtagagacagggtttttctgtgttagccaggatggtctcgatctcctgaccttgtgatccacccacctcagcctcccaaagtgctgggattacaggcctgagccaccacgcccagcctattttgtgtttttttaaagctaactaccattaagatcattatagaagtttggtataatgaagatttgggtttttcagtccaatgagtttccatattcttgaatgaaaaagatccacatttcatcatttgcctgtttcattttcttttagtacttttgaacttagtttggtcagaaaatactagaattttagtttgatctaaagaaccagcttatataacttgctgttgccatgtacatttgtatgtctttgctgtgtcaaataactggatctgattttagctctttttaagtggtgaaagcaatgcatttttattcttcaaattcagacattgaatgtgtatcacaatgtgtgtgcttacctttaatcctctctcccacgacaattaggaacacgtttctccaattactgttggcagactaccaagaaaaatgttgaattagaatcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgcctgtaatcccaactactcaggaggctgaggcaggagaattgcttgaacctgggagttggaggtcacggtgagctgatatcacgccattgcactccagcctgggcaacagagcaagactctgtctcaatcaatctatccatcaatcgataagaaccccagattgtatagctacatgttttagcccccttttcaaagtatatgttctccttggtacttattttgacattctgacttttctacatatgctttatcaacctcttaattaaaccatcattgtctattttgagagataactgcgctgcttcccgttgtgtgttttaaatgttattgttcagtttgagtcaaataaaaggatatttaatctgtggtgccttgacatt

SEQ ID NO: 6308 - DNA, 192 bp, Homo sapiens
aagaaatggcatcttagtgtaattataatttgcatttctcttatgaattaagttgaatttgcaaaaatatgcttaaggcacatttttacacccattttcggtgaattgcttgttcgtgtatcttactcatttttctagaatgtctagtcccctttttcttcactcgatataaaaagtattttttaaatatta

SEQ ID NO: 6309 - DNA, 2981 bp, Homo sapiens
gaaatgttttacttgagttttctgtgtgttgagatgaaagtctcccaggctaaagatttctgaactgcacgcaatgtctgaagaagcgcttgaaaggcactttatttctcccaggtccccaaccatgggtttaggtttttatgccagaaaggggaccttcatgaacaaagacccccaagacctagagagaagaggaagtctgaaagagggaggtttgaattcagccttcaggaatgaagagggcagacagagcaggaggctcaggcaggggagtcaggaaccacagaccagaaacatggacttggaaaggttttcatgtaattgaaatgaagctattgatccatccattttaaaagaatttgaaaaattcattaaaatacttaattagtggcatccactaattaataaaagcatagggagtggcatctttaaccaaaaatgaaaatgaagaaacagactccagcccagggaccaggggcgattatgagggacatggtgcctcatacagccaagatgatccaagaggcatcatctttaatgaagctttaacacctggcagcctgctcattgtgttgtttaagaggtaagtatgaactggttttgtttgtagcttttgtgtggaatcaggtagtgctgtctgcagagtgtaaacctttatttctttaagtaggaataacagataaagtaattctatattaaatcccaagagttttattctaaattggtaatgtgactttcatctctcgagttttttcaaatcgtttttaatttgtggttgagtcttcacgaacttcttgtcatcaggcaatagttgattccccttttttgaaagctttcaatttcatttatccttagtgttgaaaagtgtcagaaaattgaaatggacacagatgattgtatctgccctccctttcaggaaagccatgttgactttaaaatatcaaaaaagaaagttcagttatgattgcagggggtaatgatagtttgatccacaaactatttgcagtgtaaaagtgaaataccttagctgacttagttcatttttgaaagttttgaatagctaaaacaaagttggcaaataggctcatagagtagttacagagtaagactaaattcatatttgatgcagattcctctctacctcccattctgggaggatttagttttactgtttggtgtttaggataatgattgttctgtttttctcaccctactatgtgaatatatattctgttagagatgggctgttatctgcaatgtggactcaataccatgggcttgagtttggttagttcatcattagagattttttttcagcagttggtttactttatgagaaaggatcatgagtttaattttcccactgatatatttgtgttctcattgctgagatataagtttcttaatgatttgttacctttttctattttcctagactagtattaaaattttgatggcatatgggtttggttccacttgtagagaataaatgttcacaacttactggtattagcacacacacatcacatgcagaaatggtgttttcttgccacttactctttctcataagatgcttatattcctgtgggcatttgtcttccacactacagcacataatttgatgaaactgattttctgtgcaagagcttgtgtttctccaactctggttttatggaccacttttcattggtatataggaggcggttaaaacgtggtggtagaatgcaggttttaggttagctgggtgtgaagaatcccaggtctttgggatagtcttggcaagttactcaactcctctaagttagtttcttgatctgtcagatgacagtaaacctcagagttgtgaaaattaaatggatataatgtgtgtaaagcacttagcataatgctttatacatcgtaaaactttcaaaaataggagtagtaattattacaaagaaatgtgaagaagagtcctagtgggctgcatgttaaaaatagtttttagttaatgaaaattaaatcacatcttagatgtttatcatctgcatggtacttttctggttgctgctttaacctttgtatagttgaaagtctgtaaactttctagtattctttgatttctggcccatttccctcctaccattcacgcttatattttttggttcaagtcaccattccttgcaaaactaattaaatacattcctaaatacataatattgccaatattcattcacatccaccacgtctagatccaagtcttcatcttctttatgctggtctaatttttgctgagccttagaagcaaagacagactccgggggttgatatgggacctccagaatggggattgcacagaataatcttatttttcctctattcttctagtctgttatgttctgaacccacacatgttttcggaaggaccagatggctgacactggctaatgggaaccaaaagacgagtgaaagtaacctggttgtcacatacccccagcttagaggtgcttcaccctgccccaaggtcaatttcttttttctctagagactttaccccattatatcaaaaacctttactacagcctgactttatctgatgttagagtatcattaagtcaagcagcagcatttattgagtgaaaaaagattgtacacaggactggaagagaagcatctgcctttaaaatacagtagaaggccgggcatggtggctcatgcctgtaattctagcactttgggaggccaaggcaggtggattgcctgagctcaggagttcgagaccaccctgggcaacatggtgaaaccctgtctctcctaaaaaaaaaaaaaaaaattacaaaaaatttgccgggcatggtggtgcacacctgtagtcccagccactctaaaggctgaggtacaagaattgcttgagcccagggtcagaggttgcagtgagtggagatcgcgccgctgcgctgcagcctgcgcgacagagcgagactatgtttttttttaaaaaa

SEQ ID NO: 6310 - DNA, 2981 bp, Homo sapiens; identical to SEQ ID NO: 6309

SEQ ID NO: 6311 - DNA, 2981 bp, Homo sapiens; identical to SEQ ID NO: 6309

SEQ ID NO: 6312 - DNA, 537 bp, Homo sapiens
aaaatgtggtttgggtttctagtatttttttatgcttccaggtacccagaaccgcaaattttactttgagctcctcagaagaaaggtgctccaggcatctgagagaataccgttggggtgatacttacaaatttgtaagctaacactgaaatcttaaaacttccgaaaatattaatgcatttgtatgacttatttttcaactgagtatgtcaaagtactttatgaacaagtgttgtccctagtttgtactgatggggaaactgaggcatggggtgataaggtgactggcccaaggttacaaaatgagttattgacaactccggaaatagaagattttttaaattcccatactagatacatgtgggcattgacattcaaagcttccctcatgctatttcctttagtcctgtcctttggggattgcctctgagggtgagagggtagttcaggtttccaggcttgttcagcctttagtctctgtagaggcttccagcaagctgacaagttactgccaaaagtgagacagatggtattttt

SEQ ID NO: 6313 - DNA, 334 bp, Homo sapiens
aattgaatagaagtgctaaagctaaagaaagtcctaaaataattggaataggcaagtttctgaggcttcatgaaagaggtaattctcaagcatatggaagaagattgatataattcaacttgtgtagtcaaggtgttccaggtttagagagtgacataaagatacttaggagtcgttatagacttctaaacaaaaaaatgatttagtagctgacttttcctgacacaatgcaaaagacaagttgactaagtaaaaatagctctagcctagaattacataaattaatccaaatggtagagacagccctgaaggcccagcaaatgagaaaactgca

SEQ ID NO: 6314 - DNA, 334 bp, Homo sapiens; identical to SEQ ID NO: 6313

SEQ ID NO: 6315 - DNA, 537 bp, Homo sapiens; identical to SEQ ID NO: 6312

SEQ ID NO: 6316 - DNA, 537 bp, Homo sapiens; identical to SEQ ID NO: 6312

SEQ ID NO: 6317 - DNA, 328 bp, Homo sapiens
  misc_feature (278)..(278): n equals a,t,g, or c
aattgaatagaagtgctaaagctaaagaaagtcctaaaataattggaataggcaagtttctgaggcttcatgaaagaggtaattctcaagcatatggaagaagattgatataattcaacttgtgtagtcaaggtgttccaggtttagagagtgacataaagatacttaggagtcgttatagacttctaaacaaaaaaatgatttagtagctgacttttcctgacacaatgcaaaagacagttgactaagtaaaaatagctctagcctagaatacatanattatccaaatggtagagacagccctgaaggccagcaatgagaaactgca

SEQ ID NO: 6318 - DNA, 5153 bp, Homo sapiens
gaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaagtgctgcattgtttttacaaataacagtttgtagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatcccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttctga

SEQ ID NO: 6319 - DNA, 5153 bp, Homo sapiens; identical to SEQ ID NO: 6318

SEQ ID NO: 6320 - DNA, 25012 bp, Homo sapiens
tgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaaggtaactcatttgtttcctatacaaagatttttattggccaatttagtatattgtttatattaagagaattttaagagaattagttgttcatattaagagtattttaagagaatgacaatgtggataagcagctggtgtcaaactaattcagggtccttggaactagtatgattaaaatttagaagaaatgttcacttttccaacttaaaaggatttttaaaaatacaaacataattgacctacctggttcaaagaacagaagtgaggagaacttgcttaaaggtattgatgttatattttctcttgactgagtgcttgaaaaaaaattttattgaacatatgttctccttccgtggcttttttgtctttgcttttttgttttgttttgtgttttttttctttgagatggagtctcactctcttgccaggctggagtgcagtggcgtaatcccggcccactgcaacctccacctcccaggttcaagtgattctcctgcctcagcctcctgagtagctgagattacaggcacgcaccaccatgcccggctaatttttgtatttttagtagagacggggtttcaccatgttggccaggatggtcttgacctcttgaccttgtgatccacccacggcctcccaaagtgctgggattacaggtgtgagccaccacacccatttgcttatttgtttttgagacagagtctcactctctcacccaggctggagtgcagtggtgtgatcttggctcactgcaacctccgcctcttgggttcaggtgattctcctgcctcagcctcccgagtagctgggattacagccatgcgccaccacgcccagctaatttttgtattttcagtagacacgggtttccccgtgttggccaggctgatctcaaacttctgacctcgtgatccgcccgcctctgcttcccaaagtgctgtgattacaggtgtgagccaccgtgcccagcctctcctttgctttttatatcatatgcgtctttaatagtgagctcatttaatagttctaatttgattaaaatgagtagaagcactgtttttgaagaggagactgataagtcttggagtaatggatgccagtttgtaactggaaaataagttagacaaatcacagtgtcaagtatgattagcatagttgagaccaggctcttgggattctccttttcatagccctaaagcccaagtttaaagggaaccaggtatctttcaagtttcacgctaataactttcttttcttttttttctttttttttttttttttttttgagatggagtcttactcttgtcacccaggctggagtgcagtggcgcaatcttgactcactgcaacctccgcctcccgggttcaagtgattctcctgcctcagcctcccacgtagctgggattacaggtgcccaccaccacgcctggctaatttttatatttttagtagagatgaggtttcaccgtgttggccaggctggtctcaaactcctgacctcaggtgatccacccacctgggtctcccaaagtgctgggattacaggtgtgagccaccgtgccaggcctcatgttaatcactttcttagaatgtggtttgtttgtgtcttaaagaaaaattcgctgtatggcataactgtaatctaaatccttagagcaaataatgaggtttaacgatgatgtttatatccttttgcttttgagaacagtgggtttcagtcttcccatctttcctacctcttcctcctttctctaacagaaatgtatgctccatgcatgcatgtacacacttaatacatagtgcacattcccattttaacagtggctcatttaggcagtgacttacaattgcagggaaaggggaccataccagattgtgggaattgggtaattaccatattctctctggaagaaatactgcctcagggatgaataacaaagtgatttgtgacttctaagcaaatttcctagtctgcatacgtttccttatctgcaagctggaagacattgagtataataaatagatgtccttttaatatcattttacttccttaaaaatggaagtagtagaattgcttaatggaagtttaggaatcctcacagataacatttacctgatttcacttattctccagctctgctctttgaaggtaaatacaggagttggttgtttttagcaatgttagggcaaaaagataaatgcttcgttttttaagacatgtgttatacattagttaacctctgccaggagagttgggttttttggtattgttttctgtgccgtctgccctctagagactattactggaaaatgtttaccgaagtattttgcactggcgatcattgtgtgagcctgagagggtatctggttgtgttgtgttctcttaccacctccaaaatattctgggaggcccagtgtggtgggtcatgactgtaatcccagcactttgggaggccgaagtgggaggatcacttgagctcaggaatttgagaccagcctgggcaacaatgtgtagtcccagctacttgggaggcttaggagggaggatcacttgtccctgggagatccaggtctgcagtgagctatgtttgcaccactgcactcaggcctgggcaacagagtgagaccgtgtctcaaaacaaaacaacaaaatgtgtaggatatgttccattaggtaactggttaatagttcttatgtacaatttctattaggtggaattgcaggccatttttaaattggaatgttaacctgaatttactctttatgcattttccctatccatgggctagctgaatatgaaatcagtggtatttatataagctgaatacccctatatgggtgcagttatatttagttttgctggtattaatgaaaaaatttgctgtaggtaaagtgtcatcttgagttctgtatttggacatgattggaaattaatcagattggcatcaaaatttttacccctctagaacaataaataatactcagttcaattgggttccagagtagcaagttctttgaattcctgccaaatgttgattggtccattagcagtccattggccactcatttttctttacttgaattatatttggagatcttttataagtgaagccttttttttttaaagttaactctaaaagaagtaataatcagttgggctactggaatatcctttaagaacatctgtattattttctttgtgctttagtgtagttttcagatgttcagtagtaatctctaagtgagtagttgaagttgggcttagaattggaagttctctgcatttctcctgacttcaaaaataagcccttcagcaacttaatttggaaatagtgggtaagagagtgcgttatgtcacttctttaagaatggtgcactatttatttaacttatataaagaaaggtgtttttattttgttttttggtggttttttttttttttgagatggggtcttgctctgttgcccaggctggagtgcagtgtcacagtcttggctcactgcaacctccgccccctgggttcaagcgattctcctgcctcagcctcctgagtagctgggattacaggtgcacgccaccatgcctggctaattttgtatttttagtagagacagggttttaccgtgttggtcaggctggtctcctgacctcatgagccacctgccttggcctcccaaagtgctgggattacgggtgtgagccactgcacccaacaaagaaaggtgtttatttgactcaaggttttggcggctgggaagtccaagtgcatggcggcagcttctggcaagggctttttttaatacaggaagtttttagattaagcaattacttggaaccttaagcgtactatggatttttaaaaatttgagtgttaagtacaattgagggtatgaagtaaagatacaatagagcataaaaaggggatttgtgctgggtgcggtggctcacgcctgtaatcccagcactttgggaggccaaggagggtggatcacgaggtcaggagatcgaggccatcctggctaacagtgaaaccccatctctactaaaaatacaaaaaattagccgggcgtggtagcaggcacctgtagtcccagctacttgggaggctgaggcaggagaatggcgtgaacccgggaggtggaagttgcagtgagctgagatcgtgccactgcactccagcctggacgacagagcaaggctccttctaaaaaaaaaaagggtggggggtggcgggatttgtgtggattctaattccttgtgtgggattttccttttagctgttttttttttttttttttttaaagagacaggatctcattgtcacccaggctggagtgcagtggcactatcgtagctcattgcagcctggaactgggctgaagctctcctccttcctcagcctcctgagtagctagtactacaggtgtatgccaccatgcctggcctcttttagctttttatataatatgttatgccattaacttttctctttttttttgagacagggtgttgctgtgttgttgaggctggagtacagtggtgtggtcatagctcactgtagccttgagctcctgggctcaagtgatcctcctgcctcagcctcctgagtagctgggaccacaggtgtgcaccgcaatgcccagctaatttttttatttttatttttttgagatggagtctcacactgtcgccctggctggcgtgcagtggcgtgatctcggctcactgcaacctccgcctctcaggttcaagtgatttctcctgcctcagcctccctagtagctgggattacaggcatgagccaccgtgcccggctgcccagctaattcttgtattttttatatatgtatatatacatatagtgacggtgtctgtgtattttacccaggctggtcttgaactcctggcctcaagggatcctcctgcctcagcctcccaaagtgctaggattacaggtgtgggccaccatgcctgtcctaacttttcttttcctttcttttttttggagacggagcctcactctgtcacccaggatggagtacaatggtgcgatcttggctcgctgcaacctctgcctcctgggttcaagcgattctgcctcagcctcccgagtaactgggattacaggcatgtaccaccgtgcccggctaatttttttgtatttttagtagagacggggtttcgccatgttggccagactggtcttgaactcttgacctcaagttctccgcccacctccgcctccgaaagtgctgggattacaggcatgagccaccacacctggctgtgatggctcttttttaagagacagggtctcaccctgtgactcaggctggaatgcagtggtatgatcctagctcactgcacccttgaactcctgggcttaaggaatcctcccgcctcagcctcctgtgtagctgggaccataggtttgcgctaccacccatgttgtctgggctggtctggaattcctgccctcaagtgatccttctgcttcagcctccttaagtattgggattacaggcatgagccaccatgcttagcttgtgatggctcttagtgtacatacctgggacatataactgtgccttcttaaaagtagttatctcagaatgcttagcaagcctctctttgacttgactttaaaagctttgaacactagatcctaactttttgaagtaaacttttgattttgaaatggttgaaagtcatttgaagccaagtctttggaaataataattgatatgagttgtgtgtttggtcacagtgccaatttaaactgggttgatctgtcttacatggctgttatggcactgaaggatatgaagcatttgaaatgctgacattttggaatattcatttaaaaataggctggggccggacatggctcacacttgtaatcccagcacgttgggaggctgaggcgggtggatcacctgaggtcaggagtttgagaccaacctggccaacatgacgaaaccccatctctatgaaaatacaaaaattagccaggcatagtggtgcaggcctgtagtctccgctaattgggaggctgaggtgggagaatcgcttgaatctgggaggtggaagttgcagtgggctgagatcacaccactgcactctatccagcctaggagacacagcaagacttcacctcaaaaaatgaaaataaaaatagtctgggtactgtggctcttgcctataatcctagcatttttgaagtgaggcaggaaaatcacttgagctcaggagtttgagatcagcctgggcaacatagcaagtcctgatttctacaaaaaaatttgaagcattagctgggcatggtggcatgtggaggctgagatggaggatatcaccaagcccaagaggtcaaagatgcagtgagccataatcgtgctgttgcactcaaggttgtgcaacagagtgagaccctgtctcaaaaacatacaacagttggtattaagcaattacttacagatctgtgttgaggtagattaatatggcaccaatttgggtagactggaagccatttttctgttgactagaagatcagtttcttggaatagtgcaggcagaggtataataaaggtcttctgctttgtattttcaaccatgtaaatgatctgaattttaaaaaaaattttttaaaaagcttttagattgggaaagggcataagggaacagataagattacataacaagatttgggaaacaggatatgaagagacaaattatgattaatccataaaattgacaaggactaggtgtacagtttggacattgttcagagaaggatctgaatattaaattttctcttctaaacacaatgtgaataagtattttcacgtttactgcatttcattgcaattgcttcctgaatgcctatttgacatcacagctgtctttctaataatcttattaatgtgtgcctgcaaatttgacagttttaagatttgccttggttttagccctggttggattccctagatttggaaagggtacttgtttatgaggatataatgatgtgggacatatagtaatgaatataacaaataattcctaatatgggataaggtcccctttctcccagtgagagaactcatactggctgtttagtacccatactgactgcttgatgtttcatgatgtctgctttatgaatacagtaataatatattcaccttgatactggtgaaagatcacttgtaaggaatttttggaagttaaaatttaacttccagatttcactagcttaagtcctgagtgtgagggaaataaccatctatgctgtaagaagagcagacactgttactataatgatagtagcaaaaccagaaattgtttattactatcatagtagtagcagtttcattccaagctattactatcatagtagtagcagtttcattccaagcaacttttacccttataaagcacatggggggccgggcgtggtggctcaattcctgtaatcccagcactttgggaggccgaggcgggcagatcacgaggtcaggagatcgagaccatcctggctaacacggtgaaaccccgtctctactaaaaatacaaaaaattagccgggcgcagtggcgggtacctgtagtcccagctactcgggaggctgaggcaggagaatagcgtgaacccgggaggtggagcttgcagtgagccgagatcgcgccactgcagtctagcctgggggacagagcgagactctgtctcaaaaaaaaataataataaagtacatgagattagaataagagcaatagaaaagagaaaaataacaaaaacaacttgagttccgagtttctatttaggagtagtctggataattcttcttatcctggattgttgtagcttcagaaaagagttcattaaggggtctactgaaaaggtggtgacttctaactaccttaattcagaattacttgaaagcatgctgtatttctttttcttttctttccctttccctttttgattgagtttcactctcgttgcccaggctggagtccagtggcgcgatctcggctcactgctacctctacctcctgggttcaagcgatctcttgcctcagcctcctgagtagctgggattataggcttgcatcaccacgcttggctaattttgtatttttagtagagactgaggtttcaccatgttggtcaggctggtctcaaactcctgacctcaggtgatccacccacctcggcctcccaaagtgctgggattacaaccataagccaccgcacctggccggaaaacatgctatatttctctctgggtattgtcaaactgaaaaagggtggtagaaatttctgacaagcttctttgtaaaagaataggcacaagtatggcagactggttaagaaaaaggaaatcagaatagcaaaacatggtacaataacctgtaatcatccaaaaaatgggcaaatctgaattaggagggggaaagcagaattttaatttaccatgtcaccatccttgctgaattttacagaatttgatccaaaatggcttaataagggattggaaggcatgattagtgataaattgatttgggggttctcagttgtgggagtcagtttgtttggcattatgttgatttgttatctatctctggtggagccatttaatttagatgttaatttttaaaagatgttctaggttcagacgtggtggcacatgcaaatcccagcattttaggaggctgaggtgggcagatcccctgaggtcaggagttcgagaccagcctggccagtgtggtgaaacccggtctctactaaaaatacaaaaatgagccgggcatggtggcacgtgcctgtagtcccagctactccggaggcttaggcaggagaatctgttgaacctgggaggcggaggttgctgtgaaccgagattgtgctgttgcactctagtctgggcgacagagcgagactgtctccaaaaacaaacaatgttctattagctgagacaatagtattattcatttttaaatgcaaaaaataagcttctagttagctttagcccttttagcttcagtctttttccttgagggatttaataattaaatgctgtatctgttcagtttgactatatgaaattgctgtttttgtaggtcagaagaagttgagtgtgagcaatgccaaatgggtctgcctaatactgtttacagttacattattacttcctggctgacttatgaatagtatttgttcaaatcagtatctacttactgcaccaagccctgtgagaagcagtagtgataaatagatgagaggtgagagtttgtgtcattaagaaacttggtctaatagtgaaacatatggaaagaaatgtattactattgttggctgggcacagtggctcacacctgtaatcccagcactttgggaggccaaggctggcagatcacttgaggtcaggagttagagaccaccctggccaacatggtgaaactcccatctctcctaaaacaatatacaaaaattagccaggcatggtggcgcgtgcctgtagtcccagctactcaggagactaaggcaggagaatcgcttgaacctgggaggtggaggttgcagtgagccaagattgtgccaagtgtaattggaacccctaagatgggggcaaggtgagggaagggcagtcaggattccgaaaagaagtgggcattagtctgtttattgtgcctggagagtaagattactttaggtggaggaaataatagtgtttgaagattgccagccattcagtttgtttaaaggaagatgaatggtacaagtttaaagtcctttaagttagttatctaattaatctgttgatgtactagctattgtgtcaagtgctaggagacacaaattcaatttcacagtgctagtagcttttgctgtaggcagtgagaatccattgaaaagttttgagcaatgtggtcactttcagatatatatatatatatatatttgagacggagtcttactctgtcacctaggctggagtgcagtggcgcaatcttggctcactgcaacctccgcctcctgggttcaagcaattctcctgcctcagcctcctgagtagctgggattacaggcacgcaccaccactcccggctaatttttgtatttttagtagagacggggtttcaccatgttggtcaggctggcctcgaactcctgaccgcaagtgatccacccgccttggcctcccaaagtgctgggattacaggtgtgagccactgcacccggctgtcagatttacatttttaaaggaaaagaatggttagccaggttgtagaagacagaaaatgaggcctgagtaatggcaaaggaggccagttaaaaggcaactgcataaatgttgaaaagatactactgcttgagccagggcaatgacattgggctggagaaaaagagatgactagaaagttgcaagtgtcttacctttggttaagatttaccagagttgaacattgcctctgtaaattccttagtttgaatttccttgactctacccactcttatatcctatacctttactataaccttcctggggtcattctctgtttctcaaatgttgttccttgagttcccttttcatgttacatcaatttccctggataatcttgtccagttctgttactttatatactaggcttaagacttcttcagaggccaggtatggtggctcatgcctgtaatcccagcactttgggaggccgaggcaggtggatcacctgaggtcaggagttcgagaccagcctggccagcatggtgaaaccctgtatgtacaaaaaaaatacaaaaaattagccgggtatgatggcatatgcctataatcccagctgcttggggggggctgaggcaggagaattgcctgaagccaggaggtggaggttgcagtgagccgagatcgagcattccagcctgggtaatgagagtgaaactccttctcaaaaaaacaaaaaaaaaactgagttcagaccgtatatattccatatcattgctgcaattctatgtatattaaattgaattcattctcttccaaaacctgctttttctttcttgctcttagtgaattagcattaacccaattttttgtcattagatgatatggaccatttctctaagatctccatttttttcttttctatctcgcatactgtcttcatctcttcttaacatttattggactctctgtatattattgtcacttcatctgttctgttcattacctggaagaatcatcactatttagtacaataaccttagatttcttcagtggcttcccttcacctatataatgaaataacaaactttacttcatatgtagctttttactctgtcccctgaataatgttctttctctaaatctctcattcttagtgactttgtgaaccgtagcatctttgttgcaaccactcaatacttggttctgcattatagctcaaaagcagtcatagatggtacatatacagtggatgtggctgtgttcaattaaaactttttttgttgttttttaagacacggttgtctcactttattgcccaggctggagtgcagtggcatgattatagctcattgcctccttgaattcttggactcgagcaatcctcttgcttcagcctcctgagtagctgagactacaggcatgtgctgttagcacacccagctagtttttaaatgttttgtagacatagggtctcaccatcttgctaaggctggtctcaagtgatcctcccacctctgcctcccagagtgctgcaattacaggtgtgaaccaccacaggccctcattaaaactttatttgcaaaaacagatggtggatagtaattgtttgttcacccctgctcaaacacaccttgttaaagcacacacataccaccgacctttgttcattgctgatgctcttactgataacccaccctcccagtgaagttgcttactagagtaagctcacagagggcagactctttggttttgcatctataccctgagctggtgagtagtatttttttttcataccctgagctggtgagtagtatttttttttcaatcaacttggaattaagaacttgtggaaaactggacatttcgctataggaagcattgtgatagggaggtattatgtagaaagtctgctctaggaaattgaacattaacttttcatttgagtggcatagctaaatataagttttgatgtaaagaaatttcagattgggtggtggtagtggtttaaaatacagaattttaacaaaattgcctacttggtatatcttaagagcaaaaacttttacttaggttctattaggtctaattgcctacttgggtatatcttaagagcaaaaacttttacttacgttctattaggtctggccctgtgagcatttctcaataaatatttgcataattagatgctgtgatcactcttcaaaaagaactggcaagttagattttgtgctgtgtgtctgtgtgtgtgtgtgtgtgtgtgtgtgtgtagaagagagcagtgttaaaagatcaaggctgggcgtgatggctcacgcctgtagtcccagcactttgggaggccaaggtgggtggatcacctgaggtcaggagtttgagactagcctggccaacatggcggaacctgtctctactaaaaatacaaaaattggctgggcgcggtggctcacgcctgtaatcccagcactttgggaggccgaggcgggtggatcacgaggtcaggagttccaagaccagcctggccagtatggtgaaaccccatctctactaaaactacaaaaattagctggtatggtgacgtgcacctgtagttccagctacttgggaggctgaggcagaagaatcgcttgaacccaggaggcagaggttgcagtgagccgagatctcaccattgcactccagcctgggtgacagtgagactctgtctcctatatatatatatgtgtgtgtgtgtatatatatatatatatattagctgggcctggtggcgtgtgcctgtaatcccagctatttgggaggctgaggcaggatagcttgaacccaggtggtggaggttgcagtgagctgagatcgcaccactgctgctcttcagcctgggcgacagcaagactctctcaaaaaaaagaaaagaaaagaaaaaaaaaaaagaatcagttactgaggttgaccatcccaaatctgagaatctaagatccaaaatgcttcaagatccaaaatttttcagtactgacatgatgttcaaaaaggaaatgctccttttccaataatataatggaaacattccaaaatctaaaacacttctggtcccaaacatttcagataaggatactcaacttgtatgtgtatgatgattttgtataattcaaattgccttccttagccttctttatactattcacttgttttgcttctcagggatagtcaaaacattaaatcacacaaacgaggggccaggtgcagcggctcacgcctgtaatcccagcacttcgggaggccagggcgggcagatcacaaggtcaggagatcgagaccatcctggctaacacggtgaaaccccgtctctactaaaaatacaagaaattagccgggcttggtggcatgcgcctgtagtctcagctattcgggaggctgaggcgggagaatggcgtgaaccctggaggcagagcttgcagtgagccgagatagcgccactgcactccagcctgggtgacagagcaagactcttgtctcaaaaaaaaaaaaaaaaagaacacatttcatatttaaaatctgaattgagatttttgtaacctttttttgaggacagaaggtaatgtcagccctttcctatgtgttctatcgataatgtcatttgtttctttcttttcttctcttctcttctcccctcccctcccctcccctcccctcccctctcttttcgacagtctcactctgttgcccaagctggagtgcagtggcgtgatctgggctcactgcaatctctgcctcccgggttcaagtgattctcctgtctcagcctcctgagtagctaggactaccggtgcccgcccccacacttggctaacttttttgtgtttttagtagagatgggatttcaccatgttggtcaggctggtcttgaactcctgacctcaggtaatccacctgccttggcctcacaaagtgctgggattacaggtgagagccaccgcgcccggccatgtcatttcttgttagtcttgttaaggttaagcatagcatcatgcaaatgctgtttgattcattttccctttctgatcctaaccttgtttgagtttcagggaaacttttaaattttgatcaagtaaatgaagttgctagtagtcaaagaagtaattaatattaagtaacaggaagggaaattgcattcacttcttagttcagcatttctgataatgctgatttctttctttacttttctttttttttttttgagacggagtcttgctctttcgcccaggctggggtgcagtggcacgatctcggctcactgcaacctccgtctacggggttcaagtgattctcctgccttagcctgctcagtagctgggattacaggcgtgcaccaccatgcgttactaatttttgtatttttagtagagacggggtttcaccatgttggccaggctggtatcgaactccttacctcgtgatccacctgcctcggcctcccaaagtgctgagattacagatgtgagcccctccgcaccaggaatatgctgatttatttctttgctagaagcttggcttgcttcatagctagttttataggtacatcatacatccctatttccccctcagaagtcatgatcaaactcactactctagagctcacatttaagggtaataacattttatcataaatcatttttaaatgtatagtatttgagtaaaaccttaagctgcagtaaagaagtatcttcaacttgggtgtttgcaaatagttgttttgccttctttattctaaaatatgtatgtttgctttgtttttaaagtagtgttgttactgtgactctgaagtgtattctcaaaaaaaggggaaagtgcagggataggttgagtttccagtggggaagaaaaaaggaaatgttacttataggtggttaacatgaaaagttggattaactttttcttttctttcttttttcttatttattttttaataatagacacagggtctccctatgtttcccaggctggtccctcaagtgatcctcctgctttggcctcccaaagtactgggattacaggcgtgagccactatacctggccaattttttttttcagcgtatgactaaatatagatttatctttgcagtagacaaaatgaatatcaagttattactatatacataattcttcaggaatttatttgctacaaaatatgaaatttctgtgctttaaaataaaaaatattggttgtattggatcaatttttttttttgcagtaggtcaaccaagagaaggcttgtatttggacttttaaaaaataggccattctgaaatccagaaattcgtaagataataaagaacatttaactgttcctcgttgtttgaaactaatggaataagaaattatattggagtgataagtgtgatttctgtgactagaatttccgatcgtcatctttttttttttttttttctccaggttagattgattatagttctcccctttttagacctctcaggagaaagggaattttcctgcctttctttggataggtgtctgcgcagagatttgatggacataccatacaactaagcttggacaattggcacctttaaactcccagatttggtttaatcactgtaatatcttgaatgggattttatctggataattatcttattcatcctgaattattaattgatcccagtatatggatctgacaaattttcaaaaagctgagagtactgtaaaaaatattttttaaaagtgccaggcttggccaggcgcggtggctcacacctgtaatcccagcactttgggaggccgagccgggtggatcacaagatcagaagttcgagaccaccctggctaacacggtgaaaccccgtctctactaaaaatacaaaaaattagccaggcgtggtggcaggcacctgtagtcccagttactcgggaagctgaggcaagagaatggcgtgaacccgggaggcggagcttgcagtgagctgagatcgcgccactgtactccagcctgggcgactcaaaaaaaaaagtgccagacttggtggctgaggtggaaggattgcttgagcccaatagaccagcctgagcaacatagcaagaccccatctctacaaatggcatgtgtctgtggtcccagctacctgggaggctgaggcaggattgcttgaacccaggagattgaggctgcagtgagccatgattatgccactgtactccagcctgtgctatagagcaagaccttgtccccctgtgcaaaaaaaaaaaaaaatttggtttttacagttttaatttttgctaggggagtagggagagagataggaatgtgattctaccattccctgcccctatttatacacatacaatcagaaaataataattttagatctgtatcttattttgtcctacggagggattatgttgtgccttaactgtaacccaagtctagatgtatcccatcttaatgagtttcagtttttccttttctttaattgattgctgttaaattggaatgtagttacacataatagttaagcagggttaaaataatctttttgtcctttcaaaatgatagttttattaccacagaagactacttatccttaatgtttgttatagttcatttttgttactaagtagtttgtgttaatctccagatagaatatttcctttcaaggtccaattctttggttcttgtgtaatagtcaattactgttgactatatatagccccctgaagctttcatgtatcacaggtagagtttttaactgcattctctgtgtatgtcgctataatttgtacatgtacataattttcttattttaagatgccaaactaagcacattgtagacattttggatgaaattagaacaaatgattgtgtgccattaataatagatgtggattggcattctgaccttaaaggataaaataagaggtgtggttagggctgggtgtggtggctgatgcttgtaatcccagcactttggggggctgaggtgggcggatcacttgaggttgggagttcaagaccagcctcacaaacaaggagaaaccccctctctactaaaaaaaaatatatatatacaaaattatctgagcatggtggcgcatgcctgtaatcccagctactcgggaggctgaggcaggagaatcgcttgaacccgggagggggatgttgcggtgagccgagatcgtgccattgcgctccagcctgggcaacaagagtgaaactccatgctgggggtaaaaataaataaataaataaaaataaaaaagaggtgtggtttagaggttagaactacttgcctgaatggttaaactaattaaacatcaattttaattagtcaaatttgatgaatgctttgttcaaaaaatttgggcacctcattgaggagtcagtggattaccaagaaatacttggtgttttttaaataatgatgagctgttatgagaagtattattttatctgtagcatgtgtcttgcatgtccttgcaatttgtgaagacaaaattattctggcaatttgatttcaggtaataatctacatgacacttaagaattataagagccagccgggctggcacagtggctcgcgcctgtgatcccagcattttaggaggccgaggtgggcggatcacctgaggtcaggagttcaagaccatcctggccaacatggtgaaaccccatctctactaaaaatacaaaaattagctgggcgtggtggcgggcacctgtaatcccagctactcgggaggttgagacaggagaagcgctggaacccgagaggcggaggttgcagtgagccgagatcaggccactgcactccagcctgggtaacagagcgaaactcagtctcaaaaaaacaaaagagttacaggatccaggctcacgcctgaggcaggaggaccagcctgggcaacagactccatctctaccaaagaaaaaaagaaaaattagctgggtgtgatggcatgcggctatagttgagaggctgaggtgggaggataacttgagcctgggagtttgaggctgcagtaacagagcaagaccctgtctcttaaaaaaaagaaaactataggaaaatatgaatgctttatctgaacttcatagaattttgccattttcaaccctacctccagtctggcagtaatcagtctaggatttttagatttaaaatgaaaagcatcgcttcagactttgctcaccaaaacttagtatgtaattctctttttttctttgcagaaatggaatctatttggaatttgcagaagcaaggtaagaatgattagattacttaaaatgtcactaataagtaaccactggacattatttttgggtgggattaacagatgggtggtaatttaccaaatagactttgtattttgagttatttaataactgcaatcaaaaggcactagcagctgggcagggtggctcatgcctctaatcccaacactgtgggaggccaaggcgggaggattgctgaagtccaggagttcaagaccagcctgggcagcatagccagaccccgtctctattttttaaattaaaaaaaaaaaaaaaatgtagggccgggcacggtggctcacgcctgtaatcctagcactttgggaggctgaggcgggtggatcacccgaggtcaggagttcaagaccagcctggccaacatggtgagaccctgtctctactaaaaatacaaaaattagctgggcgtggtggcaggcgcctgtaattccagctacttgggaggctgaggcaagagaatagcttgaacccaggaggcagaggttatggtgagccgagattgtgccattgcactccagcctgggcaacaagagcgaaacgccatctccaaaaaaaaagatagtattaagagtgaatacgaaaaaagaaaacagcaacaaaaagacactaccataccaggactggcgaggatggggcaatactgtaagtgaaaaaaacagatgaaagtattatttacctactagatgaagatatgaatgatttttttcccctcctggttatgaaagtaagacaagccataaatgttattaatgtaggaaaccaacaagaataagtatttccacttttggctggtctttctctgtatttgtgtggtagacaacaaacagcctaagaattgaaattcatagttcagaaaaatattagctgttataggagcctgaattgtatcctattcattttgaattgaatagtatacaattcctgaattgtatcctattcctcatttactttgctaattaatgtaagtgaatttcagatggatgtgaaattcctagaatttcaggacttgaaatgtgtagaaatttctcttattttacatattaggaaagtgaggcccagtgaggttcctgtaaactagaaagtggcaggactagaatgtagcttcccctgatttcccaatgttgctctttcttccggagttactttctgtgtatcttaccaaacaaatgaaaaaaacatagactagaaaatacaccctgcaggctgggcacggtggctcacgcctggaatcccagcactttgggaggcggaggcaggtggatcacctgaggttcaggagttcaagaccagcctggccaacatggtgaaaccccatttctattaaaacagttagccaggcgtggtggcacatgcctgtaaatcccagctactagggaggctgagccaggagaatcgcttgaacacaagagatggaggttgcagtgagctgagatcacgccattgctctccagcctgggcaacaagaacgaaacttcgtctgaaaaaaaggaaaagaaaatataccctgcaaagtagacctacctgtttttactgtaaaatggccgttaactcttaggaatgagcatgttcttcatggcagatttccaatgggtggccctaggagtcccagaaaggatattattatattatctctggactaaactagattgattcttagctgaagtggacttgagtttttctgatactattttcaggcctttaaaattttccattgggtgaccagttgtattgacttgccttttttttttttttttttaagcatgtatacttgaaaaagttcttagggaaggtagaaattatatatgtgtgtgtatatatataatataatatatataataaaataatatataataaaaacagttccctggccgggcgcggtggctcacgcctgtaatcccagcactttgggaggccgaggcgggcggatcacgaggtcaggagatcgagaccatcctggctaacacggtgaaaccccgtgtctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaataaaataaaataaaaaaataaaaataaaaacagttcccctccagaagaggggagcatgcagcttaaatagtaagaatttagaataaccctggagtcttcttccagacacattctaacagttttatgttttgaatctgaaagatccatagtcttttgttagtgctgagaataaaggctggtgttactgtgggaagttgagtcagtcttgattaggactgaattggcagttttgctaattaatttaacgtcaagtttttggtggcaggttttacttagatagttcccacactggttaaaataaattttgacttcatttgctgggaacagcaaaagaaaaatccaagtgtttcttttaatattggattattggtgacaagcttttttctttggctgctgtattcaaatacactgcttttgtaatcagtagaagtacataaaacccttaagtgaactcaaccatctctgatctgcaggagttgaggccctcactggctagaggaccctgtacttggaattcattggaattccaaatagctacttccaggttgagaaactggatcatacatgtgttggtacaaggaggaaatgggcttgaagttttgttttcataaaaaaattggtcagtttaaatgatggttatttgggattgttattggaatacgggcattttgagattctagaccttatttttatttatttttttaacctttctagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtg

SEQ ID NO: 6321 - DNA, 134 bp, Homo sapiens
cgggcagatcacctaaggtcgggagttcgagaccagcctgaccaacatggagaaaccccgtctctactaaaaatacaaaattagccaggtgtggtggtgcatgcctgtaatcccagctactcgggaggctgagg

SEQ ID NO: 6322 - DNA, 134 bp, Homo sapiens; identical to SEQ ID NO: 6321

SEQ ID NO: 6323 - DNA, 3201 bp, Homo sapiens
agatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttggggtcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtg

SEQ ID NO: 6324 - DNA, 10598 bp, Homo sapiens
cttggagagagcagacgccttctggattcaagaagacgaggtgagctgaggtacctggctttagtgaagaccctgtgggggcttcctggctgcggcttcgacgtgcctgactccacacgcccctaaggtttgaagaaaacctgctggaggtttgggacctaaccgcatcaaagtcgcctttagcggtgcctggacccagttcgcacgggaggaagtaggaggcagaatcccctttgggccacagaaagtaacgatctggactcggttcgggccgtgaaagggagggatgcagacctagttgggaccgcagaaaggaaggatcgagaaatccttcagacggtagcaagaggggaggaggatacacacagttcgggagggagataggagacggcaggactccgtttaggctggagaaagggggcagtaccccgtttgggccacagaatggagggatcgggacccagagataagagtgggcagcatcccttttgagcaacggaaaggaccagactcagacaggagaaaggaggggatatgacccggttggttccggtttgaaagggaagagacaggacctggtagggtttgagaacaggaatacacagaaggttcatacagttggatttgggggtgaggtattcatgttgcagaaagggcggagctgcacacttgcagacgtggaaagaggggggagtggtgttggttggggaaggggtggtgcagagacgtaccgcagagcggagggagggggcttattaaaggaagggaagatgaagagaaatgctgcagagcggagggaggggggtgtattgggaaggggcggtgcgtggcagtaccgcagaggagagatgggcggtgttggggtaggggcggtgcggagtggtactgcagagcggagggagggggctagtgttgggggaagggttggatcgagatgtgatgcagttagaaagagtgggtcggggtggcgccaagatgttctgttgctctgagagcagggggcagatgtgggattgagctggttagaaactgtccggtttaccaaggcgcatgcgcgcggagggcattgaagaatggttcttttgggatagaggtgggcctaagatggggggtgggggcgcctctagtcggtgcgcatgcgcactatcgagttgcggagggggcgtgtaaaggggtggggtcgtagaactgactctctcggaggcaaaaggagctgggccttggaaaccagatggcctgggttttttaggtatgaaaacccaggagttgaagggattagggcccaaggttacatgagactcccctaagtcaggataggtgagatgtctgatgaatctccccctccctctcattctctaactcaggcccattcccctcaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaaggtgagatctctgacattgccatccttaactttgtgcttcttttccatttctacccttctagtttgttcatttcttctataaaagttttactttgagctagtccctgtgttcagataggctgtggaagatgctgagaagaaggtgatatagtttctgctccctagcagttcacagattggtgaggaaataagacatccatacactcagctacaacctgtatgtaatactacttgtatttaaatagtagttaccacgtgccaggctttgtgttgggtacagttacacagggtatgtctgaatgtcttgaaagtaactcttaccaacaagggatcataggtcccagttttacacttaagaaaactgagtctcagagaaatgaagtgacttgtccaagaggtaccagccagcataattggtggtagccagaggaagagaaagacccttaggctcttatcttgagttgttcctggcctggcagaggaacgaaactccttcctggaagacagtgaaagataagctcaggactcagggtggccaatggcaaggtcaggatcaggctccactacagcaaggctgagggagggggttagagggactttctgtctggagcaggcaaggtgaggagacagagccatctctttcacctggtgactctggaccttccttctttctgatgatgaagtccaagcatctgaatggggatgagagaagtggcagtaattacaggcggatcccatggggccggaggcctgcaccaccgcgagatgtggccattttacaagaaagggtaagaatccaatgctgtccagtctcttctcttcttcacttgccctcttctctgcctccttccaagttttctgcaagcatgttaagatctctccatctattcctctcctcccaggctaataagttggtgaaatacctgttggttaaggaccagacaaagatccccatcaaacgctcaggtagtgtcctaccaaccctcctccttgagctctcctctccactcccctctcctcccatagtctgggagtaacactttatggcctctttgttctgtcatatctccacacctgccctccttgcactctgccatggctggcatctcccattaactcacttcaggtctctgattgcactgacccaacaggactggcaaaagggctgcagctctgtggcccctgctaagctcagctactctcacctctccttttctacagacatgctgagggatgtcatccaagaatatgatgaatatttcccagaaatcattgaacgagcaagctacactctggagaaggtgaaggggcagtgctggcggatgggcgcaatggggaagctttgaatcgagcaaagacatacatgtcccttttggagagaatcacagaaacatgctaatccagccccattactgtgtgaatgggcagacagtggcctagggagaggtgtagatttgccatgggtcacacagcatgtcagtgatgaaaacatggctaggacagaagccactcaaattagtctcagcttctattcatagttggacatattctgcatgtatttcagatctcacctctcccttgtatccccattttctgtctccctagattcctgctcatcacaaagatgatgttgatgacaatagtacatttgctgtgtgtttactgggtgccaggcacttggctatgtgctttatgtgcattatctcactgacttcttacacatgcagaccccctaagtacactgggagttttaggatgcccggaaagttcactgatacctaagctgaattttgtgatctcacaggctattcttttacttggcagatgtttcgagtcaatctgaaagaaattgataagcaaagtagcttgtatattctcatcagcactcaggaatcctctgcaggcatactgggaacgtaagctgggaaagggctggagtgggaaggaagcttctgcttttatctgtgctgctaccccttctttgtcctacttcccccatcctcttagagagtcaggaaaaacagggtctcaaaagccctgtctcagcacctgcacatagttggagccctgctcacagtagtggcacctgattatgattgactgaagggtataggagcctagggtgggacattcctgctgtcaggtttgctgtctctgtagaagcttcccaggaaagcaggcctgtcattgcttgcctcttccgatggagtgcctggcctggctttgacagagtggttctcaaggagggcttcctggtgtggctggatcagtatgcatgaagcgcaagagtgtcagtggggctgaaggttctgggagagaaagaagggactcacattgactgagtgcttgtgttgtaccaggttgacagccattcttccatcttcttggcaacctgaggaagggagaatatgattttcccattttactgaataatagaccaaggcttgcaaggtctaagtgccttgcccagggtggcatagagctggaagcagagactgggcagaattctgtatctgaggaatctgggagaggttagcctggtgagctggctggtgtatcttttgcggatggctgctgaaacataaaccttctttctgtcctgttgaaacataaaccttctttctgtcctgttattcccttaggaccaaggacacacccaagctgggtctcctcatggtgattctgagtgtcatttttatgaatggcaacaaggccagtgagggtgagtggctgggcatgcagctgaatgggcggccatggtctggattccatgtgttcaatttctgtccctgtctcctcttgcctcccctcacagctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtaagtggtgtttggggctttgtctggccctgaagtgttctgggtatactgatctggttcagaaagtgcttagtcagtgcctttcttatactagctttagagggatgggcatcctgtgtcctagaactgatactgtctaaaattcccatgggcagacctttccaggactgggccagactcaacacaaggcccttgcagtggggtgcgctcagagcagagggccttaagaatggctcctctgtttacaacacacccaacaggaatctgggcttactcctcacaggtggcatgatactttggccttcctgtgacatcatgccctatacatgtctcccctggagaagcccaagggactgctttgcacagggccagtgggaaatggctcagtattggaggccaagaccataaactgtgtttggtagtgagtctggggctggagggtcttagaaatccctctccaggggctgtttgtatttgtttggaggaggttgccacctggtgtctagtgcttagacagcagggttgcttggttagaaacaagtttcatttcctttttccaaggtacctggagtacaagagggtccctaacagcagaccacctgaatatgagttcttctggggcttgcgctcctaccacgagactagcaagatgaaagtcctcaagtttgcatgcagggtaagaggagagctgcccgagcttggcatattaaggcaatgggatacccttggctggggcaggcaatgcacagggatgggcaggtacagagcagcctgcagctcatatataaacatgtggagcctcctttatgtcccagggtgctgctagatatatagtttacatcatctcattcattcttcatactttgtattaatcagcatgggctgccataacaaaataccatagactgggtggattaaaaaacaaatttattttctcatagttcttgagggcgagaatcctaggtcagggtccacgagggtcagttcctgttgaaggctctcttcctggcttgcagatggctgccttcttgctgtgtcctcacatggctttgtgtgtgagagagaagagagcaagctttctggtgtctcttcttataaggacactaatcctgttgatcaggaccccacccttatggcctcatttaaccttaattatctccataaaggccctatctccaagtacaatcacactgggtgttagggattcaacatacgaatttgggggcgggcacaacccttcagttcataacatatttacgctctatcatttcctgtaattataaagacacttaggctaagtgaggttaagtaacttgtccaaggtcatatagcacgtaagtcagcagagctgaaactggagttcagaactgacccatgatagagccccaataactgagaagtttaaaaaagtattgctactagtttaatacaaagcccgtaggttaatacatgattactagggttgttttcttattatgattatcatccccatttcaggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcaggtaactgcaatatttccatagccaggacccacagggatgggtacaagagctgggagatgttgtaagaaacactaaggcaggacagcagggtggaaaggtgagggcaattaaggaattatgagaagacagtgtatttggtgctaaaatgtgttcctatttgttttgttttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaattgga

SEQ ID NO: 6325 - DNA, 14809 bp, Homo sapiens
catgaacagacgcttctcaaaagaagacatttatgcagccaaaaaacacatgaaaaaatgctcaccattactggccgtcagagaattgcaaatcaaaaccacaatgagataccatctcacaccagttagaatggcaatcattaaaaagtcaggaaacaacaggtgctggagaggatgtggagaaataggaacacttttacactgttggtgggactggaaactagttcaaccattgtggaagtcagtgtggcaattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgataggctggattaagaaaatgtggcacatatacaccatggaatactatgcagccataaaaaatgatgagttcatgtcctttgtagggacatggatgaaattggaaatcatcattctcagtaaactatctcaagaacaaaaaaccaaacaccacatgttctcactcataggtgggaattgaacaatgagaacacatggacacaggaaggggaacatcacactctggggcctgttgtggggtggggggaggggggagggatggcattaaggatatacctaatgctaaatgacgagttaatgggtgcagcacaccaacatggcacatgtatacatatgcaactaacctgcacattgtgcacatgtaccctaaaacttaaagtagaataataaaaaaaaaaaaaaaactaggagttaggtacaaagtatagttagatagaatgagtaagatcgagtgtttgatagcacaacagggtgactatagtcaacaataatttatagtacattaaaaataactaaaatagtataattggaatatttgtaacacaaagaaatgcttgaggtgatggataccctatttaccctggtgaaattattacacattgtatgcctgaatcaaaatgtctcatggaccgtacaaatatatacacaatctaccaataaaaataaaaaataaaaacatctaaaaataatgaactttttgagtaagtttagatttacagaaaagttgcaaaaatagtacagataattgctgtatacctctcactaagtcgcccctaattttatcatcttatttttaccatgttatattcactaaacctaggaaaccaacactgatatataacagaactctacactttcatgtttgtccatgaatgtcctttttgtattccaggatccaatccaggataccacattccatttagttggcatgtcttgcagtatcctttgatctctgatagtctatttttggttttcatgagcttgacggttttgaggaatactggttagcctttctgtacaatgtccctcaatttgggtttgtcttatttttgtttacttgattaaactgggtttatgggattttacatcataacagggagtacaggatatccacatgacatcattagtgatgttaactttgattacttggttaagatactgtttgctagatttattcacaaccctattcacaatacaattactattttcccctttccatactttgttctttagaattaagtcactaagttcaatctacaatgaaggggtagttaacctccacctcctattagtacagaggggctacatattctacttgaaattcttctttaggaaagacttgtgtcttctcctacattgatttattcattatattatttatcagtatggccacatgtatatgctttaaattttattttattatccatattttttgaaatccaatactacatcatttattttcttgctcaaattgtttcaactttggccactgggagctcttttgagtgggctctagtgaccttttgacatatcccattcctttgttttttgagtatttccttactttctggtactacaagatgtcacaagttcactttgtattttttttaaagcccagtcctagaatcagtcatttctccaaagggctctggttccttttattggaaaacaatatttagaaatcactaagtgatgggtttactaattgttattgggggtgttattatttctaggccttctcaatgagagctagggaatgtatttcttctttatgcttaaaccatacatgcatagatatatttaattgtttctgtattcatccatctgtgtatatattaaactaaacattttttttttgtttctgttgcccaggctggagtgtagtggtgcgatctcggctcattgcaacctccacctcttgggatcaagcgattctcctgcctcagcctcccaagtagctgggattacaggcatgtgccaccatacccagctaatttttgtattttcagtagagacagggttttgccatattggccaggctggtttcaaactcctgacttcaggtgatctgcccaccttgtcccaaagtgctgagattgctggtgtgagccactgtgcctggccaactaaacataatttcatactgcagtttctgacttcaattcaggactgcatgctgagttctagcctacccatcttacttatctgtaacttctctctctgatggtaagaagtctggctcccaccatctaccatccctttacttatttattcaaccccagtatacatgtaaagcagtttctaaattactaacccacactacaatgatgaaaataatttataacctaaactacagcatgtatgtaaagttccttttgtttttagcctttcagtttccagtcaaaacacagttttccaaagttacttgggtaagctcttccttttcttcacatcttcacaaagttacttaggtaagctcttcctttttttgtccttcacttcctttttcaaccttcactatgcaaatatatgtcattgtagcatatatttgtaatatagttagattcatttgtcattgtctatatgtcatccagggatccctgtatatcctggctaattgtttcttttttttttttttttgcatatattgatgtttagtctttgtgatgtatagttctatgggttttgataaatgcatagagttatgtatccatcaccccaatgccatatagaacagttcccagcccaaatgcctatcaatgatagaccggataaagaaaatgtggtatatacacaccatggaatactatgcagccataaaaaggaatgagatcatgtccattgcagggacatggatgaatctggaagccatcatcctcagcaaactaaaacaggaacagaaaaccaaacactgcatgttctcactcataagtgggagctgaataatgagaacacatggacacagggaggggaacaacatacactgcagcctgtccttggggggcgaggggagggagagcatcaggacaagtagctaatgcatgcagggcttaaaaccaaggtgacaagttgatagttgcagcaaaccaccatagcacacgtatacatatgtaacaaacctacatgttctgcacatgtatcccagaacttaaagtaaattttttttagaaaaggaagtatgggtaccaaaacagagatatagatcaatggaacagaacagagccttcagaaataatgacacaactctctgatctttgacaaacctgagaaaaacaagcaatggggaaaggactccctatttaataaatgatgctgggaaaactggctagccatatgtagaaagctgaaactggatccctttcttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaggaatggcaacaaaagccaaaattgacaaatgggatctaattaaactcaagagcttctgcacagcaaaagaaactaccatcagagtgaacaggcaacctacaaaataggagaaaatttttgcaacctactcatctgacaaagggctaatatccagaatctacaatgaactcaaacaaattgacaagaaaaaaacaaacaaccccatcaaaaagtgggcaaaggacacgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactggaaactagttcaaccattgtggaattcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtcgaacaatgataggctggattaagaaaatgtggcacatatacaccatggaatactatgcagccataaaaaatgatgagttcatgtcctttgtagggacatggatgaaattggaaatcatcattctcagtaaactatctcaagaacaaaaaaccaaacaccgcatattctcactcataggtgggaattgaacaatgagaacacatggacacaggaaggggaacatcacactctggggcctgttgtggggtagggggaggggggagggatagcattgggagatatacctaatgctagatgacaagttagtgggtgcagtgcaccagcatggcacatgtatacatatgtaactaacctgcacattgtgcacatgtaccctaaaacttaaagtagaataataataaataaataaataaagtaagtaatgggtttttcaacttggctttcatggaatttatattgtcttggggtcactgagattctcatatatgaaaatttatcttttgcctcatttggaaagctttcagtttttacttcttcaaatgtattttctgcccaagtcctgtctctttggaactccaattatacatatgttagttgcattgataatgttcatcaggtctctgagttttgtttattttttccccaacatttttctccatgttactcagatctaataatttttatcattctatctttaaggtaactatttttttccctctgtaactggcattctgttattgagcccatccaatgtattttaattttacttattgcattcctcagttctaaaattttcatttgtgtttttcttacaggttctatttctcttccgaagtttcttttcccttcattcatttcaaatatggttttctgtaccttatggagtatagttacaatagctgctttcaagttatgtctcataattccaacatttaagtctcttttgttttgtcacatattgattttcttcttccttgagaatggggcacattttctggttctttgacatggactaattttctatcatatcctggacattgcagatgttattttgtgtagcctctgggttgttataatcttctgaaaaatgttgatgcttttcttttagcaggcaatcaacccagttagattctggccatcagttctgtcttgccttttctgggttatagttaaaatctcagtatagttcttaaaactggtatatatatatttatatatatatatttatatatataaatatatatatttatatatatatatataaatatatatatttatatatatatatttatatatataaatatatatatatttatatatatatttatatatatatttatatatatatatttatatatatatatatttatatatatatatatttgaggctgagacttttgtaggcgatttaattctctgctcagttccctaagcctttaaatacttgtttggttaattcttgaacatgcattgtttaatggttggggtgagaattgtgtggtttcatacacatatatgggaatattttctctatctcttttccttctgagacttcttgttcatgctgcatcctacccaggttcttttttctgcttcctctggccagaaagatggcagagaatccctcagagttttagtcatgtgctctgctccagtctgtgagtgggacacactcatggcaaggctgagaggagaaaaaaaaccctggacaacttacccttatgcaggtcacttctctatgttttaactctcttccacaatctgcctggttttagttaccttgcagagtgcttaggcaggttttcttttctttaaaaaaatttgaccagaatttttaggtataattaatcagtgtggtggtgcctgtagggggtttatactgccatagctgagtgggaacttctaagagcactgtattttaaatttcattctatttctcacttctttatttaacattatgttgataactatccatgttgttatatacagatttaatcgattatcttttcccactgcatgagatcattgtaagagatcaaacgcaaatgctcatacaacaatttacatatttattctgtgattatacactgctaggttgcccaaactttttgctaccacaaataatgccatgataaacatcctgtacatgtcacttagtaggccagaaagagatcttttctggagtggcatttctcagttatagtgtgaatgattcttaatttcgctaaatactgccagattgctcttcaagatgacttcactggtttgcattctcaattgaagtacctaagggttcttgtttcccctcatcggttgacataatctgatttgcttatttttcctattttatgggtgctgaatgaggtctcaggcatcacattgcctgacttcaaactgtgctataaggccatagtcaccaaaacagcatggtactggtataaaaataagcatacaaactgatggaactgaacagagaacccagaaataaagccaaatacttaaaagccaactgatcttcaacaaagcaaacaaaaacataaagtggggaaaggacactctattcaacaaatggtgctggcataattgggaagccacaagtagaaaaataaaaccggatcctcatctctcatcttatacaaaaatcaactcaaatggaacaaagacttaaatctcaggcctgaaaccacaaaagttttaaaagataacattgggaaaacattctagacatggggaaatgcaacaaaaacaaagataaatacatgcaacttaattaaactaaaaagcttctgcacagcaaaagaattaatcagtagggtaaacagacaacccacagagtgggagaaaatcttctcaatctatatatccagcaaataactaatatccagaatctacaaggaactgaaaccaatcagcaagaaaaaacaaacaatcccatcaaaaagtggacatgaatagacaattctcaaaagaagatatacagatggccaacaaacatatgaagaaatgctcaacatcactgattactagggaaatccaaatcaaaaccacaatgcaataaccaacttactcctgctagaatggccataatcaaaacaataaaaaaatagtagatgttagcatggatgtggtgaaaagggaacacttttacactactagtgggaatgtaaaatagtacaaccactatggaaaacagtgtggagattccttaaagaactaaaggtagatctaccatttgatccagcaatcccactactgggtatctacccagaggaaaagaagtcattatatgaaaaagacacgtgtgcacgcatgtttataggagtaaaattcacagttgcaaaaatatggaaccagcccaaatgcccatcaatcaagtagataaagaaattgtgattttatatatatatatatataataccataaaaggaggtcttaaagatcattatatatacatttatatatgaatatataattatataattatatataaaataataatataatatctataataatataagaatatattataaatttatatataataatgtaatatatattataaatttatatataaatatttatatataatataatatatactatatataaattatatatagtatatataatatataatacaatataatataatatataatatgtattatatttattatactatataatatactatatattatatagtatactatataatataatgtaatatataaattatatatatttatatattagtatataataataattatatatttatacacaaatatatataattattataatatataatgacctttaagatcttcttttatggttattgtatatatataatcacagtttctttatctacttgttgatcgattgatgagcatttgggctggttccatatttttgcaactgtgaattgtactgctataaaaatgcgtgcacaagtgtctttttcatataatgacttcttttcctctgggtagatacccagtagtgggattgctggatcaaatggtagatctacctttagttctttaaggaatctccacactgttttccacagtggttgtactagtttacattcccaccagtagtgtaaaagtgttcccttttcaccacatccgtgccaacatctattattttttattttttttgattatggccattctagcaggagtaagttggtattgcatgtgattttgatttggatttccctggtaattagtgatgttgagcatttcttcatatgtttgttggccatctgtatatcttcttttaagaattgtctattcatgtccgctttttgatgggattgttttttcttgctgattggtttcagttccttgtagattctggatattagttatttgttagatatatactaatacgtatatcagtatatatatacgatatactaatacgtatatcgtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatactatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactaatacgtatgtcagtatatatatactatatactatacgtatgtagtatatatatactatatactataagtatgtcagtatatatatactatatactaatacgtatgtcagtatatatatacatatactaatacgtatgtcagtatatatatacatacactaatacgtatattagtatatatatacatatactaatatgtatgtgagtatatatactaatatacatatgtatactatatgtatactaatatgtatactaatatacatattagcatatatactaatatacatattagcatatatactaatatacatattagcatatatactaatatacatattagtatatatactaatatacttatacatattagtatatatactaatacacttatacatattagtatatatactaatatacttatacatattagtatatatactaatacacttatacatattagtatatatactaatacacttatatatattagtatacacactagtatatatatctatatatctggatataagttatttgtcagatatataggtatatattatatgttatattatatattatatatatagtcaataataatttaattgtacatttaaaaataagtaaaagagtatatatatcatgatatattatataatatataatattaagtaatatatactttatattatatataatcacagtttatctacttgttgattgatgggcatttatatatacacacacactcacacacacacacacacacacacacacatatatatatatatatatatatatatatatacacaccatagaatgctacccagctgtaaaaaggtatgaaataatcacattctcagcaacctggatggaattggagaccattattctaagtgaagttaactcaggaatggaaagccaaacatcatcgtatgttctcacttaagtggatgttaagctgtgaggacgcaaaggcctaagaataatacaatggactttggggacttgggggaaaggttgggaggagttgagggataaaagactacacattggatacagtgtacactgctcggtgatgcatgcaccataatctcagaaatcaccactacggaacttattcatgtaaccaaacaccacttcttcccttaaaacctattgaatttaaaattaaaaaaagaaatacaactgatttttgtatgttgaatttgtttcttagttattttttgtggattctttatctacatataaagttatgtggtctgctaacagggacaattaaacttcttttttttccaaattggattacatttctttctcttgctgaggatgtcagtactatgttgaatataagtggtgagagcaggcatacttgctttattcctgaccttagagaaaaggctttccacttttcaccattgagtaggatgttagctataggtttgttgtatatgagctttattgtattgaggtacgtttccttttatacctaatttgctgagcgctttttcttaaaatcaagaattattgttgaattttatcaacgccttttctgcatctactgagatgatcatgtggtttctgtcctttattctgttaaggtattctatcacatttagtgatttgcatgtgttgaaccatccttgcatccttgggataaatcacacttgatcatgatgaacgatctttttaatatggtgttgaatttggtttgctagtattttgctgaggagtttgcatctatgttcctcagggatactggtctgtaattttcttttcttctagtgtctttgtctggttttggtgtcagggtaattctggttctgtaaaatgactttggaagtgtttctttctcttcaatgtattggtagaatttgaaaaggattgatattcattcctctttaaatgtttggtaaaattcagcagtggatccaccaggtctggagattttctttgatgagagacttttatcactgatttagtctcctttcccattacatatctgtttagattttctatttcttcaagcttaagtcttggtaggttttatgtgtctaggaatgtatccatttcttctaggttatccaatttcctggcatataattgttcttagtattctcttaaaatcttttgcttttctgtggtattaattgtaatgtctcctctttcatttctgattttgagtcttctcttgttttttcttagttgatctagctaagggcttgtcaatcttatttatcttttcataaaaccaactcttggtttcactgatttttttcctattgtttctctaatctctacttcatttacttctgctctgatctttattatttccttttttctactaattttgagcttatttgttcttttttttccagttccttgaagtgtgatgttagattgtttgggatcttttttctttttgatgtatgtatttattgctataaacttcgttcttagaagtgcttttgctgcattctataagttttagtatgttgtatatacattttcgcttgtctcaagatattttaaattttccctttaatttcttccttgacgtattggttattctggaatatgttttttgatttccatatatttatgaatgttccacaattcttatcattaatgatttctagttccataccactgtgcatatattacttgatgtgatttcaatattcttaaatttgttaagacttgtttttgtctgtcactttgaaaaaattcaacaaccttcatgctaaaaactctcaataaattaggtattgatgggatgtatcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgactgtatatctagaaaaccccattgtctcagctcaaaatctccttaagctgataagcaacttcagcaaagtctcaggatacaaaatcaatgtacaaaaatcacaagcattcttatacaccaataacagacaaacagagagccaaatcatgagtgaactcctattcacaattgcttcaaagagaataaaatacctaggaatccaacttacaagggatgtgaaggacctcttcaaggagaactacaaaccactgctcaatgaaataaaagaggatacaaagaaatggaagaacattccatgctcatggctaggaagaatcaatatcgtgaaaatggccatactgcccaaggtaatttatagattcaatgtcatccccatcaagctaccaatgactttcttcacagaattggaaaaactactttaaagttcatatggaaccaaaaaagagcccgcatcaccaagtcaatcctaagccaaaagaacaaagctgggggcatctcgctacctgacttcaaactatactacaaggctagagtaaccaaaacagcatggtactagtaccaaaacagagatacagatcaatggaacagaacagagccctcagaaataatgccgcatatctacaactatctgatctttgacaaacctgagaaaaacaagcaatggggaaaggattccctatttaataaacggtgctgggaaaactggctagccatatgtagaaagctgaaactggatcccttccttacaccttatacaaaaattaattcaagatggatgaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaagtgggatctaatttaactcaagagcttctgcacagcaaaagaaactaccatcagagtgaacaggcaacttacagactgggagaaaatttttgcaacctactcatcagacaaagggctaacatccagaatctacaatgaactcaaacaaattgacaagaaaaaaacaaacaaccccatcaaaaagtaggtgaaggacatgaatagacacttctcaaaagaagacatttatgcagccaaaaaacacatgaaaaaatgctcaccatcactggccgtcagagaaaggcaaatcaaaaccacaatgagataccatctcacaccagttagagtggcaatcattaaaaagtcaggaaacaacaggtgctggagaggatgtggagaaataggaacacttttacactgttggtgggactggaaactagttcaaccattgtggaagtcagtgtggtgattcctcagggatctagaactagaaataccatttgacccaggcatcctattactgggtatacacccaaaggactataaatcatgctgctataaagacacacgcacacatatgtttattgcggcattattcacaatagcagagacttggaaccaacccgaatgtccaacaacgatagactggattaagaaaatgtggcacatatacaccatggaatactatgcagccataaaaatgatgagttcatgtcctttgtagggtcatggatgaaattggaaatcatcattctcagtaaactactgcaaggacaaaaaaccaaacaccgcatattctcactcataggtgggaattgaacaatgagaacacatggacacaggaaggggaacatcacactctggggactgttgtggggtggggggaggggggagggatagcattaggagatatacctaatgctaaatgacgagttaatgggtgcagcaccccagcatggcacatgtatacatatgtaactaacctgcacattgtgcacatgtaccctaaaacttaaagtagaataataataaaataaaataaaaaa
